United States Patent 11,446,398 (REGULATED BIOCIRCUIT SYSTEMS) - sequence listing, part 16

SEQ ID NO: 69424 - protein, 950 aa, Homo sapiens
  Payload ID: 13771
  Gene Symbol: PTPRN
  Gene Name: protein tyrosine phosphatase, receptor type, N
  Uniprot ID: Q16849
  ENSP ID: ENSP00000386638
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQNVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 69425 - protein, 125 aa, Homo sapiens
  Payload ID: 13771
  Gene Symbol: PTPRN
  Gene Name: protein tyrosine phosphatase, receptor type, N
  ENSP ID: ENSP00000388429
MSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFG

SEQ ID NO: 69426 - protein, 889 aa, Homo sapiens
  Payload ID: 13771
  Gene Symbol: PTPRN
  Gene Name: protein tyrosine phosphatase, receptor type, N
  Uniprot ID: Q16849
  ENSP ID: ENSP00000392598
MSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 69427 - protein, 124 aa, Homo sapiens
  Payload ID: 13771
  Gene Symbol: PTPRN
  Gene Name: protein tyrosine phosphatase, receptor type, N
  ENSP ID: ENSP00000395379
MSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQF

SEQ ID NO: 69428 - protein, 86 aa, Homo sapiens
  Payload ID: 13771
  Gene Symbol: PTPRN
  Gene Name: protein tyrosine phosphatase, receptor type, N
  ENSP ID: ENSP00000396464
MSQGLSWHDDLTQYVISQEMERIPRLRPPEPRPRDRSGLAPKRPGPAGELLLQDIPTGSAPAAQHRLPQPPVGKGGAGASSSLSPL

SEQ ID NO: 69429 - protein, 137 aa, Homo sapiens
  Payload ID: 13771
  Gene Symbol: PTPRN
  Gene Name: protein tyrosine phosphatase, receptor type, N
  ENSP ID: ENSP00000396842
  MOD_RES (1)..(1): Any amino acid
XWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGPV

SEQ ID NO: 69430 - protein, 67 aa, Homo sapiens
  Payload ID: 13771
  Gene Symbol: PTPRN
  Gene Name: protein tyrosine phosphatase, receptor type, N
  ENSP ID: ENSP00000397105
MSQGLSWHDDLTQYVISQEMERIPRLRPPEPRPRDRSGLAPKRPGPAGELLLQDIPTGSAPAAQHRL

SEQ ID NO: 69431 - protein, 166 aa, Homo sapiens
  Payload ID: 13771
  Gene Symbol: PTPRN
  Gene Name: protein tyrosine phosphatase, receptor type, N
  ENSP ID: ENSP00000408036
MRDEEGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSL

SEQ ID NO: 69432 - protein, 52 aa, Homo sapiens
  Payload ID: 13771
  Gene Symbol: PTPRN
  Gene Name: protein tyrosine phosphatase, receptor type, N
  ENSP ID: ENSP00000475591
MRRPRRPGGLGGSGGLRLLLCLLLLSSRPGGCSAVSAHGSGEGHGVHVGRGT

SEQ ID NO: 69433 - protein, 986 aa, Homo sapiens
  Payload ID: 13772
  Gene Symbol: PTPRN2
  Gene Name: protein tyrosine phosphatase, receptor type, N polypeptide 2
  Uniprot ID: Q92932
  ENSP ID: ENSP00000374064
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDREVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 69434 - protein, 998 aa, Homo sapiens
  Payload ID: 13772
  Gene Symbol: PTPRN2
  Gene Name: protein tyrosine phosphatase, receptor type, N polypeptide 2
  Uniprot ID: Q92932
  ENSP ID: ENSP00000374067
MGPPLPLLLLLLLLLPPRVLPAAPSSVPRGRQLPGRLDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 69435 - protein, 1015 aa, Homo sapiens
  Payload ID: 13772
  Gene Symbol: PTPRN2
  Gene Name: protein tyrosine phosphatase, receptor type, N polypeptide 2
  Uniprot ID: Q92932
  ENSP ID: ENSP00000374069
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 69436 - protein, 457 aa, Homo sapiens
  Payload ID: 13772
  Gene Symbol: PTPRN2
  Gene Name: protein tyrosine phosphatase, receptor type, N polypeptide 2
  ENSP ID: ENSP00000385464
TGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVE

SEQ ID NO: 69437 - protein, 977 aa, Homo sapiens
  Payload ID: 13772
  Gene Symbol: PTPRN2
  Gene Name: protein tyrosine phosphatase, receptor type, N polypeptide 2
  ENSP ID: ENSP00000387114
MGPPLPLLLLLLLLLPPRVLPAAPSSVPRGRQLPGRLGCLLEEGLCGASEACVNGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 69438 - protein, 38 aa, Homo sapiens
  Payload ID: 13772
  Gene Symbol: PTPRN2
  Gene Name: protein tyrosine phosphatase, receptor type, N polypeptide 2
  ENSP ID: ENSP00000487683
  MOD_RES (1)..(1): Any amino acid
XGVFGRCQKVPAMDFYRYEVSPVALQRLRVALQKLSGT

SEQ ID NO: 69439 - protein, 38 aa, Homo sapiens; identical to SEQ ID NO: 69438
  Payload ID: 13772
  Gene Symbol: PTPRN2
  Gene Name: protein tyrosine phosphatase, receptor type, N polypeptide 2
  ENSP ID: ENSP00000488132
  MOD_RES (1)..(1): Any amino acid

SEQ ID NO: 69440 - protein, 38 aa, Homo sapiens; identical to SEQ ID NO: 69438
  Payload ID: 13772
  Gene Symbol: PTPRN2
  Gene Name: protein tyrosine phosphatase, receptor type, N polypeptide 2
  ENSP ID: ENSP00000488906
  MOD_RES (1)..(1): Any amino acid

SEQ ID NO: 69441 - protein, 1216 aa, Homo sapiens
  Payload ID: 13773
  Gene Symbol: PTPRO
  Gene Name: protein tyrosine phosphatase, receptor type, O
  Uniprot ID: Q16827
  ENSP ID: ENSP00000281171
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 69442 - protein, 1188 aa, Homo sapiens
  Payload ID: 13773
  Gene Symbol: PTPRO
  Gene Name: protein tyrosine phosphatase, receptor type, O
  Uniprot ID: Q16827
  ENSP ID: ENSP00000343434
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 69443 - protein, 405 aa, Homo sapiens
  Payload ID: 13773
  Gene Symbol: PTPRO
  Gene Name: protein tyrosine phosphatase, receptor type, O
  Uniprot ID: Q16827
  ENSP ID: ENSP00000393449
MVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 69444 - protein, 405 aa, Homo sapiens; identical to SEQ ID NO: 69443
  Payload ID: 13773
  Gene Symbol: PTPRO
  Gene Name: protein tyrosine phosphatase, receptor type, O
  Uniprot ID: Q16827
  ENSP ID: ENSP00000404188

SEQ ID NO: 69445 - protein, 377 aa, Homo sapiens
  Payload ID: 13773
  Gene Symbol: PTPRO
  Gene Name: protein tyrosine phosphatase, receptor type, O
  Uniprot ID: Q16827
  ENSP ID: ENSP00000437571
MVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 69446 - protein, 377 aa, Homo sapiens; identical to SEQ ID NO: 69445
  Payload ID: 13773
  Gene Symbol: PTPRO
  Gene Name: protein tyrosine phosphatase, receptor type, O
  Uniprot ID: Q16827
  ENSP ID: ENSP00000439234

SEQ ID NO: 69447 - protein, 597 aa, Homo sapiens
  Payload ID: 13773
  Gene Symbol: PTPRO
  Gene Name: protein tyrosine phosphatase, receptor type, O
  Uniprot ID: Q16827
  ENSP ID: ENSP00000444173
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVVIFP

SEQ ID NO: 69448 - protein, 88 aa, Homo sapiens
  Payload ID: 13773
  Gene Symbol: PTPRO
  Gene Name: protein tyrosine phosphatase, receptor type, O
  ENSP ID: ENSP00000445621
  MOD_RES (1)..(1): Any amino acid
XVTLLWVEEGVADFFEVFCQQVGSSQKTKLQEPVAVSSHVVTISSLLPATAYNCSVTSFSHDSPSVPTFIAVSTMGSVELVHLSILHP

SEQ ID NO: 69449 - protein, 116 aa, Homo sapiens
  Payload ID: 13773
  Gene Symbol: PTPRO
  Gene Name: protein tyrosine phosphatase, receptor type, O
  ENSP ID: ENSP00000446201
WKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCR

SEQ ID NO: 69450 - protein, 332 aa, Homo sapiens
  Payload ID: 13774
  Gene Symbol: PTPRQ
  Gene Name: protein tyrosine phosphatase, receptor type, Q
  ENSP ID: ENSP00000447522
MKHSRDPNAVTVSWPSARSLLDGYIISISSESLMREEILPSTKRTFTFNSLSPGTDFLISIMTNKGLKRSHPTVLMVSTYPDPSDLLIWGQEENTICLSWKLSEGGFEKFQISYCMPSRQEKLIKVIVYGNKAKVKKLTLGMDYMFQVKKVKGKGYSVSVMKKVPIKPEQPEKLRAFNISTHSFSLHWSLPSGHVERYQVDLVPDSGFVTIRDLGGGEYQVDVSNVVPGTRYDITISSISTTYTSPVTRIVTTNVTKPGPPVFLAGERVGSAGILLSWNTPPNPNGRIISYIVKYKEVCPWMQTVYTQVRSKPDSLEVLLTNLNPGTTYEIK

SEQ ID NO: 69451 - protein, 353 aa, Homo sapiens
  Payload ID: 13774
  Gene Symbol: PTPRQ
  Gene Name: protein tyrosine phosphatase, receptor type, Q
  ENSP ID: ENSP00000448844
MKHSRDPNAVTVSWPSARSLLDGYIISISSESLMREEILPSTKRTFTFNSLSPGTDFLISIMTNKGLKRSHPTVLMVSTYPDPSDLLIWGQEENTICLSWKLSEGGFEKFQISYCMPSRQEKLIKVIVYGNKAKVKKLTLGMDYMFQVKKVKGKGYSVSVMKKVPIKPSRICGLILKAVNISSNLMWNTTEINFTHYKIYISNRTFAKDCLIWEVVTEHTVTDVTPGVIYNIMVHRIRGNLGGCGMFTRVVAEPEQPEKLRAFNISTHSFSLHWSLPSGHVERYQVDLVPDSGFVTIRDLGGGEYQVDVSNVVPGTRYDITISSISTTYTSPVTRIVTTNVTKPGPPVFLAGE

SEQ ID NO: 69452 - protein, 283 aa, Homo sapiens
  Payload ID: 13774
  Gene Symbol: PTPRQ
  Gene Name: protein tyrosine phosphatase, receptor type, Q
  ENSP ID: ENSP00000449133
MHKLCCCFHAPSAAEFMKHSRDPNAVTVSWPSARSLLDGYIISISSESLMREEILPSTKRTFTFNSLSPGTDFLISIMTNKGLKRSHPTVLMVSTYPDPSDLLIWGQEENTICLSWKLSEGGFEKFQISYCMPSRQEKLIKVIVYGNKAKVKKLTLGMDYMFQVKKVKGKGYSVSVMKKVPIKPEQPEKLRAFNISTHSFSLHWSLPSGHVERYQVDLVPDSGFVTIRDLGGGEYQVDVSNVVPGTRYDITISSISTTYTSPVTRIVTTNVTKPGPPVFLAGE

SEQ ID NO: 69453 - protein, 146 aa, Homo sapiens
  Payload ID: 13774
  Gene Symbol: PTPRQ
  Gene Name: protein tyrosine phosphatase, receptor type, Q
  ENSP ID: ENSP00000449526
  MOD_RES (1)..(1): Any amino acid
XILSVTLCILSIILLGTAIFAFARIRQKQKEGGTYSPQDAEIIDTKLKLDQLITVADLELKDERLTRPISKKSFLQHVEELCTNNNLKFQEEFSELPKFLQDLSSTDADLPWNRAKNRFPNIKPYNNNRVKLIADASVPGSDYINA

SEQ ID NO: 69454 - protein, 2299 aa, Homo sapiens
  Payload ID: 13774
  Gene Symbol: PTPRQ
  Gene Name: protein tyrosine phosphatase, receptor type, Q
  ENSP ID: ENSP00000482885
MDFLIIFLLLFIGTSETQVDVSNVVPGTRYDITISSISTTYTSPVTRIVTTNVTKPGPPVFLAGERVGSAGILLSWNTPPNPNGRIISYIVKYKEVCPWMQTVYTQVRSKPDSLEVLLTNLNPGTTYEIKVAAENSAGIGVFSDPFLFQTAESAPGKVVNLTVEAYNASAVKLIWYLPRQPNGKITSFKISVKHARSGIVVKDVSIRVEDILTGKLPECNENSESFLWSTASPSPTLGRVTPPSRTTHSSSTLTQNEISSVWKEPISFVVTHLRPYTTYLFEVSAATTEAGYIDSTIVRTPESVPEGPPQNCVTGNITGKSFSILWDPPTIVTGKFSYRVELYGPSGRILDNSTKDLKFAFTNLTPFTMYDVYIAAETSAGTGPKSNISVFTPPDVPGAVFDLQLAEVESTQVRITWKKPRQPNGIINQYRVKVLVPETGIILENTLLTGNNEYINDPMAPEIVNIVEPMVGLYEGSAEMSSDLHSLATFIYNSHPDKNFPARNRAEDQTSPVVTTRNQYITDIAAEQLSYVIRRLVPFTEHMISVSAFTIMGEGPPTVLSVRTRQQVPSSIKIINYKNISSSSILLYWDPPEYPNGKITHYTIYAMELDTNRAFQITTIDNSFLITGLKKYTKYKMRVAASTHVGESSLSEENDIFVRTSEDEPESSPQDVEVIDVTADEIRLKWSPPEKPNGIIIAYEVLYKNIDTLYMKNTSTTDIILRNLRPHTLYNISVRSYTRFGHGNQVSSLLSVRTSETVPDSAPENITYKNISSGEIELSFLPPSSPNGIIQKYTIYLKRSNGNEERTINTTSLTQNIKVLKKYTQYIIEVSASTLKGEGVRSAPISILTEEDAPDSPPQDFSVKQLSGVTVKLSWQPPLEPNGIILYYTVYVWNRSSLKTINVTETSLELSDLDYNVEYSAYVTASTRFGDGKTRSNIISFQTPEGAPSDPPKDVYYANLSSSSIILFWTPPSKPNGIIQYYSVYYRNTSGTFMQNFTLHEVTNDFDNMTVSTIIDKLTIFSYYTFWLTASTSVGNGNKSSDIIEVYTDQDIPEGFVGNLTYESISSTAINVSWVPPAQPNGLVFYYVSLILQQTPRHVRPPLVTYERSIYFDNLEKYTDYILKITPSTEKGFSDTYTAQLYIKTEEDVPETSPIINTFKNLSSTSVLLSWDPPVKPNGAIISYDLTLQGPNENYSFITSDNYIILEELSPFTLYSFFAAARTRKGLGPSSILFFYTDESVPLAPPQNLTLINCTSDFVWLKWSPSPLPGGIVKVYSFKIHEHETDTIYYKNISGFKTEAKLVGLEPVSTYSIRVSAFTKVGNGNQFSNVVKFTTQESVPDVVQNMQCMATSWQSVLVKWDPPKKANGIITQYMVTVERNSTKVSPQDHMYTFIKLLANTSYVFKVRASTSAGEGDESTCHVSTLPETVPSVPTNIAFSDVQSTSATLTWIRPDTILGYFQNYKITTQLRAQKCKEWESEECVEYQKIQYLYEAHLTEETVYGLKKFRWYRFQVAASTNAGYGNASNWISTKTLPGPPDGPPENVHVVATSPFSISISWSEPAVITGPTCYLIDVKSVDNDEFNISFIKSNEENKTIEIKDLEIFTRYSVVITAFTGNISAAYVEGKSSAEMIVTTLESAPKDPPNNMTFQKIPDEVTKFQLTFLPPSQPNGNIQVYQALVYREDDPTAVQIHNLSIIQKTNTFVIAMLEGLKGGHTYNISVYAVNSAGAGPKVPMRITMDIKAPARPKTKPTPIYDATGKLLVTSTTITIRMPICYYSDDHGPIKNVQVLVTETGAQHDGNVTKWYDAYFNKARPYFTNEGFPNPPCTEGKTKFSGNEEIYIIGADNACMIPGNEDKICNGPLKPKKQYLFKFRATNIMGQFTDSDYSDPVKTLGEGLSERTVEIILSVTLCILSIILLGTAIFAFARIRQKQKEGGTYSPQDAEIIDTKLKLDQLITVADLELKDERLTRLLSYRKSIKPISKKSFLQHVEELCTNNNLKFQEEFSELPKFLQDLSSTDADLPWNRAKNRFPNIKPYNNNRVKLIADASVPGSDYINASYISGYLCPNEFIATQGPLPGTVGDFWRMVWETRAKTLVMLTQCFEKGRIRCHQYWPEDNKPVTVFGDIVITKLMEDVQIDWTIRDLKIERHGDCMTVRQCNFTAWPEHGVPENSAPLIHFVKLVRASRAHDTTPMIVHCSAGVGRTGVFIALDHLTQHINDHDFVDIYGLVAELRSERMCMVQNLAQYIFLHQCILDLLSNKGSNQPICFVNYSALQKMDSLDAMEGDVELEWEETTM

SEQ ID NO: 69455 - protein, 2332 aa, Homo sapiens
  Payload ID: 13774
  Gene Symbol: PTPRQ
  Gene Name: protein tyrosine phosphatase, receptor type, Q
  ENSP ID: ENSP00000483259
MKKVPIKPEQPEKLRAFNISTHSFSLHWSLPSGHVERYQVDLVPDSGFVTIRDLGGGEYQVDVSNVVPGTRYDITISSISTTYTSPVTRIVTTNVTKPGPPVFLAGERVGSAGILLSWNTPPNPNGRIISYIVKYKEVCPWMQTVYTQVRSKPDSLEVLLTNLNPGTTYEIKVAAENSAGIGVFSDPFLFQTAESAPGKVVNLTVEAYNASAVKLIWYLPRQPNGKITSFKISVKHARSGIVVKDVSIRVEDILTGKLPECNENSESFLWSTASPSPTLGRVTPPSRTTHSSSTLTQNEISSVWKEPISFVVTHLRPYTTYLFEVSAATTEAGYIDSTIVRTPESVPEGPPQNCVTGNITGKSFSILWDPPTIVTGKFSYRVELYGPSGRILDNSTKDLKFAFTNLTPFTMYDVYIAAETSAGTGPKSNISVFTPPDVPGAVFDLQLAEVESTQVRITWKKPRQPNGIINQYRVKVLVPETGIILENTLLTGNNEYINDPMAPEIVNIVEPMVGLYEGSAEMSSDLHSLATFIYNSHPDKNFPARNRAEDQTSPVVTTRNQYITDIAAEQLSYVIRRLVPFTEHMISVSAFTIMGEGPPTVLSVRTRQQVPSSIKIINYKNISSSSILLYWDPPEYPNGKITHYTIYAMELDTNRAFQITTIDNSFLITGLKKYTKYKMRVAASTHVGESSLSEENDIFVRTSEDEPESSPQDVEVIDVTADEIRLKWSPPEKPNGIIIAYEVLYKNIDTLYMKNTSTTDIILRNLRPHTLYNISVRSYTRFGHGNQVSSLLSVRTSETVPDSAPENITYKNISSGEIELSFLPPSSPNGIIQKYTIYLKRSNGNEERTINTTSLTQNIKVLKKYTQYIIEVSASTLKGEGVRSAPISILTEEDAPDSPPQDFSVKQLSGVTVKLSWQPPLEPNGIILYYTVYVWNRSSLKTINVTETSLELSDLDYNVEYSAYVTASTRFGDGKTRSNIISFQTPEGAPSDPPKDVYYANLSSSSIILFWTPPSKPNGIIQYYSVYYRNTSGTFMQNFTLHEVTNDFDNMTVSTIIDKLTIFSYYTFWLTASTSVGNGNKSSDIIEVYTDQDIPEGFVGNLTYESISSTAINVSWVPPAQPNGLVFYYVSLILQQTPRHVRPPLVTYERSIYFDNLEKYTDYILKITPSTEKGFSDTYTAQLYIKTEEDVPETSPIINTFKNLSSTSVLLSWDPPVKPNGAIISYDLTLQGPNENYSFITSDNYIILEELSPFTLYSFFAAARTRKGLGPSSILFFYTDESVPLAPPQNLTLINCTSDFVWLKWSPSPLPGGIVKVYSFKIHEHETDTIYYKNISGFKTEAKLVGLEPVSTYSIRVSAFTKVGNGNQFSNVVKFTTQESVPDVVQNMQCMATSWQSVLVKWDPPKKANGIITQYMVTVERNSTKVSPQDHMYTFIKLLANTSYVFKVRASTSAGEGDESTCHVSTLPETVPSVPTNIAFSDVQSTSATLTWIRPDTILGYFQNYKITTQLRAQKCKEWESEECVEYQKIQYLYEAHLTEETVYGLKKFRWYRFQVAASTNAGYGNASNWISTKTLPGPPDGPPENVHVVATSPFSISISWSEPAVITGPTCYLIDVKSVDNDEFNISFIKSNEENKTIEIKDLEIFTRYSVVITAFTGNISAAYVEGKSSAEMIVTTLESAPKDPPNNMTFQKIPDEVTKFQLTFLPPSQPNGNIQVYQALVYREDDPTAVQIHNLSIIQKTNTFVIAMLEGLKGGHTYNISVYAVNSAGAGPKVPMRITMDIKAPARPKTKPTPIYDATGKLLVTSTTITIRMPICYYSDDHGPIKNVQVLVTETGAQHDGNVTKWYDAYFNKARPYFTNEGFPNPPCTEGKTKFSGNEEIYIIGADNACMIPGNEDKICNGPLKPKKQYLFKFRATNIMGQFTDSDYSDPVKTLGEGLSERTVEIILSVTLCILSIILLGTAIFAFARIRQKQKEGGTYSPQDAEIIDTKLKLDQLITVADLELKDERLTRPISKKSFLQHVEELCTNNNLKFQEEFSELPKFLQDLSSTDADLPWNRAKNRFPNIKPYNNNRVKLIADASVPGSDYINASYISGYLCPNEFIATQGPLPGTVGDFWRMVWETRAKTLVMLTQCFEKGRIRCHQYWPEDNKPVTVFGDIVITKLMEDVQIDWTIRDLKIERHGDCMTVRQCNFTAWPEHGVPENSAPLIHFVKLVRASRAHDTTPMIVHCSAGVGRTGVFIALDHLTQHINDHDFVDIYGLVAELRSERMCMVQNLAQYIFLHQCILDLLSNKGSNQPICFVNYSALQKMDSLDAMEGDVELEWEETTM

SEQ ID NO: 69456 - protein, 657 aa, Homo sapiens
  Payload ID: 13775
  Gene Symbol: PTPRR
  Gene Name: protein tyrosine phosphatase, receptor type, R
  Uniprot ID: Q15256
  ENSP ID: ENSP00000283228
MRRAVCFPALCLLLNLHAAGCFSGNNDHFLAINQKKSGKPVFIYKHSQDIEKSLDIAPQKIYRHSYHSSSEAQVSKRHQIVNSAFPRPAYDPSLNLLAMDGQDLEVENLPIPAANVIVVTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 69457 - protein, 545 aa, Homo sapiens
  Payload ID: 13775
  Gene Symbol: PTPRR
  Gene Name: protein tyrosine phosphatase, receptor type, R
  Uniprot ID: Q15256
  ENSP ID: ENSP00000339605
MQSISKQTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 69458 - protein, 451 aa, Homo sapiens
  Payload ID: 13775
  Gene Symbol: PTPRR
  Gene Name: protein tyrosine phosphatase, receptor type, R
  Uniprot ID: Q15256
  ENSP ID: ENSP00000368054
MNQKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 69459 - protein, 412 aa, Homo sapiens
  Payload ID: 13775
  Gene Symbol: PTPRR
  Gene Name: protein tyrosine phosphatase, receptor type, R
  Uniprot ID: Q15256
  ENSP ID: ENSP00000391750
MILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 69460 - protein, 412 aa, Homo sapiens; identical to SEQ ID NO: 69459
  Payload ID: 13775
  Gene Symbol: PTPRR
  Gene Name: protein tyrosine phosphatase, receptor type, R
  Uniprot ID: Q15256
  ENSP ID: ENSP00000446943

SEQ ID NO: 69461 - protein, 141 aa, Homo sapiens
  Payload ID: 13775
  Gene Symbol: PTPRR
  Gene Name: protein tyrosine phosphatase, receptor type, R
  ENSP ID: ENSP00000448049
MNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKRRLTGLAPAHTWHSTFPWAKLSGSRCPHPMTRACAGAITPPC

SEQ ID NO: 69462 - protein, 198 aa, Homo sapiens
  Payload ID: 13775
  Gene Symbol: PTPRR
  Gene Name: protein tyrosine phosphatase, receptor type, R
  ENSP ID: ENSP00000449616
MILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSL

SEQ ID NO: 69463 - protein, 1501 aa, Homo sapiens
  Payload ID: 13776
  Gene Symbol: PTPRS
  Gene Name: protein tyrosine phosphatase, receptor type, S
  ENSP ID: ENSP00000262963
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKKKPHSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 69464 - protein, 1910 aa, Homo sapiens
  Payload ID: 13776
  Gene Symbol: PTPRS
  Gene Name: protein tyrosine phosphatase, receptor type, S
  Uniprot ID: Q13332
  ENSP ID: ENSP00000269907
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 69465 - protein, 1505 aa, Homo sapiens
  Payload ID: 13776
  Gene Symbol: PTPRS
  Gene Name: protein tyrosine phosphatase, receptor type, S
  ENSP ID: ENSP00000327313
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 69466 - protein, 1948 aa, Homo sapiens
  Payload ID: 13776
  Gene Symbol: PTPRS
  Gene Name: protein tyrosine phosphatase, receptor type, S
  Uniprot ID: Q13332
  ENSP ID: ENSP00000349932
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSETFESTPIRGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 69467 - protein, 128 aa, Homo sapiens
  Payload ID: 13776
  Gene Symbol: PTPRS
  Gene Name: protein tyrosine phosphatase, receptor type, S
  ENSP ID: ENSP00000465185
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLRGP

SEQ ID NO: 69468 - protein, 1910 aa, Homo sapiens; identical to SEQ ID NO: 69464
  Payload ID: 13776
  Gene Symbol: PTPRS
  Gene Name: protein tyrosine phosphatase, receptor type, S
  Uniprot ID: Q13332
  ENSP ID: ENSP00000465443

SEQ ID NO: 69469 - protein, 1501 aa, Homo sapiens
  Payload ID: 13776
  Gene Symbol: PTPRS
  Gene Name: protein tyrosine phosphatase, receptor type, S
  Uniprot ID: Q13332
  ENSP ID: ENSP00000467398
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 69470 - protein, 1948 aa, Homo sapiens; identical to SEQ ID NO: 69466
  Payload ID: 13776
  Gene Symbol: PTPRS
  Gene Name: protein tyrosine phosphatase, receptor type, S
  Uniprot ID: Q13332
  ENSP ID: ENSP00000467537

SEQ ID NO: 69471 - protein, 79 aa, Homo sapiens
  Payload ID: 13776
  Gene Symbol: PTPRS
  Gene Name: protein tyrosine phosphatase, receptor type, S
  ENSP ID: ENSP00000468455
MAPTWGPGMVSVVGPMGLLVVLLVGGCAAEEPPRFIKEPKDQIGVSGGVASFVCQATGDPKPRVTWNKKGKKVNSQRFE

SEQ ID NO: 69472 - protein, 90 aa, Homo sapiens
  Payload ID: 13776
  Gene Symbol: PTPRS
  Gene Name: protein tyrosine phosphatase, receptor type, S
  ENSP ID: ENSP00000468803
MAPTWGPGMVSVVGPMGLLVVLLVGGCAAEEPPRFIKEPKDQIGVSGGVASFVCQATGDPKPRVTWNKKGKKVNSQRFETIEFDESAGAV

SEQ ID NO: 69473 - protein, 1450 aa, Homo sapiens
  Payload ID: 13777
  Gene Symbol: PTPRT
  Gene Name: protein tyrosine phosphatase, receptor type, T
  ENSP ID: ENSP00000348408
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 69474 - protein, 1451 aa, Homo sapiens
  Payload ID: 13777
  Gene Symbol: PTPRT
  Gene Name: protein tyrosine phosphatase, receptor type, T
  ENSP ID: ENSP00000362280
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRHPAEHTVGNATLGRAASPGMVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 69475 - protein, 1441 aa, Homo sapiens
  Payload ID: 13777
  Gene Symbol: PTPRT
  Gene Name: protein tyrosine phosphatase, receptor type, T
  Uniprot ID: O14522
  ENSP ID: ENSP00000362283
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 69476 - protein, 1440 aa, Homo sapiens
  Payload ID: 13777
  Gene Symbol: PTPRT
  Gene Name: protein tyrosine phosphatase, receptor type, T
  ENSP ID: ENSP00000362286
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFNGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 69477 - protein, 1463 aa, Homo sapiens
  Payload ID: 13777
  Gene Symbol: PTPRT
  Gene Name: protein tyrosine phosphatase, receptor type, T
  Uniprot ID: O14522
  ENSP ID: ENSP00000362289
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLSQRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 69478 - protein, 1460 aa, Homo sapiens
  Payload ID: 13777
  Gene Symbol: PTPRT
  Gene Name: protein tyrosine phosphatase, receptor type, T
  ENSP ID: ENSP00000362294
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 69479 - protein, 1431 aa, Homo sapiens
  Payload ID: 13777
  Gene Symbol: PTPRT
  Gene Name: protein tyrosine phosphatase, receptor type, T
  ENSP ID: ENSP00000362297
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 69480 - protein, 313 aa, Homo sapiens
  Payload ID: 13777
  Gene Symbol: PTPRT
  Gene Name: protein tyrosine phosphatase, receptor type, T
  ENSP ID: ENSP00000480136
GSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCA

SEQ ID NO: 69481 - protein, 1059 aa, Homo sapiens [sequence omitted]

SEQ ID NO: 69482 - protein, 47 aa, Homo sapiens
  Payload ID: 13777
  Gene Symbol: PTPRT
  Gene Name: protein tyrosine phosphatase, receptor type, T
  ENSP ID: ENSP00000484248
MASLAALALSLLLRLQLPPLPGARAQSAAGVAVPLMSTTATVVIVWL

SEQ ID NO: 69483 - protein, 1076 aa, Homo sapiens
  Payload ID: 13777
  Gene Symbol: PTPRT
  Gene Name: protein tyrosine phosphatase, receptor type, T
  ENSP ID: ENSP00000484524
  MOD_RES (1)..(1): Any amino acid
XPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 69484 - protein, 1446 aa, Homo sapiens
  Payload ID: 13778
  Gene Symbol: PTPRU
  Gene Name: protein tyrosine phosphatase, receptor type, U
  Uniprot ID: Q92729
  ENSP ID: ENSP00000334941
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGRDHYAYSYYPKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 69485 - protein, 1436 aa, Homo sapiens
  Payload ID: 13778
  Gene Symbol: PTPRU
  Gene Name: protein tyrosine phosphatase, receptor type, U
  Uniprot ID: Q92729
  ENSP ID: ENSP00000362884
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 69486 - protein, 1433 aa, Homo sapiens
  Payload ID: 13778
  Gene Symbol: PTPRU
  Gene Name: protein tyrosine phosphatase, receptor type, U
  Uniprot ID: Q92729
  ENSP ID: ENSP00000392332
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 69487 - protein, 1440 aa, Homo sapiens
  Payload ID: 13778
  Gene Symbol: PTPRU
  Gene Name: protein tyrosine phosphatase, receptor type, U
  Uniprot ID: Q92729
  ENSP ID: ENSP00000432906
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDIRINREGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISREGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 69488 - protein, 2315 aa, Homo sapiens
  Payload ID: 13779
  Gene Symbol: PTPRZ1
  Gene Name: protein tyrosine phosphatase, receptor-type, Z polypeptide 1
  Uniprot ID: P23471
  ENSP ID: ENSP00000377047
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDDRGSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 69489 - protein, 1448 aa, Homo sapiens
  Payload ID: 13779
  Gene Symbol: PTPRZ1
  Gene Name: protein tyrosine phosphatase, receptor-type, Z polypeptide 1
  Uniprot ID: P23471
  ENSP ID: ENSP00000410000
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFEEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 69490 - protein, 422 aa, Homo sapiens
  Payload ID: 13780
  Gene Symbol: PROZ
  Gene Name: protein Z, vitamin K-dependent plasma glycoprotein
  Uniprot ID: P22891
  ENSP ID: ENSP00000344458
MAGCVPLLQGLVLVLALHRVEPSATSLKERHGLHSDSACTGVQESLFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 69491 - protein, 400 aa, Homo sapiens
  Payload ID: 13780
  Gene Symbol: PROZ
  Gene Name: protein Z, vitamin K-dependent plasma glycoprotein
  Uniprot ID: P22891
  ENSP ID: ENSP00000364697
MAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 69492 - protein, 127 aa, Homo sapiens; identical to SEQ ID NO: 61800
  Payload ID: 13781
  Gene Symbol:
  Gene Name: Protein-arginine deiminase type-4  [Source:UniProtKB/Swiss-Prot
  Acc:Q9UM07]
  ENSP ID: ENSP00000486726

SEQ ID NO: 69493 - protein, 663 aa, Homo sapiens; identical to SEQ ID NO: 61799
  Payload ID: 13781
  Gene Symbol:
  Gene Name: Protein-arginine deiminase type-4  [Source:UniProtKB/Swiss-Prot
  Acc:Q9UM07]
  Uniprot ID: Q9UM07
  ENSP ID: ENSP00000487021

SEQ ID NO: 69494 - protein, 694 aa, Homo sapiens; identical to SEQ ID NO: 61801
  Payload ID: 13782
  Gene Symbol:
  Gene Name: Protein-arginine deiminase type-6  [Source:UniProtKB/Swiss-Prot
  Acc:Q6TGC4]
  Uniprot ID: Q6TGC4
  ENSP ID: ENSP00000485805

SEQ ID NO: 69495 - protein, 256 aa, Homo sapiens
  Payload ID: 13783
  Gene Symbol: PRTN3
  Gene Name: proteinase 3
  Uniprot ID: P24158
  ENSP ID: ENSP00000234347
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 69496 - protein, 215 aa, Homo sapiens
  Payload ID: 13783
  Gene Symbol: PRTN3
  Gene Name: proteinase 3
  ENSP ID: ENSP00000475174
MASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 69497 - protein, 215 aa, Homo sapiens; identical to SEQ ID NO: 69496
  Payload ID: 13783
  Gene Symbol: PRTN3
  Gene Name: proteinase 3
  ENSP ID: ENSP00000478164

SEQ ID NO: 69498 - protein, 256 aa, Homo sapiens; identical to SEQ ID NO: 69495
  Payload ID: 13783
  Gene Symbol: PRTN3
  Gene Name: proteinase 3
  Uniprot ID: P24158
  ENSP ID: ENSP00000478977

SEQ ID NO: 69499 - protein, 82 aa, Homo sapiens; identical to SEQ ID NO: 37553
  Payload ID: 13784
  Gene Symbol:
  Gene Name: Protein-cysteine N-palmitoyltransferase HHAT  [Source:UniProtKB/Swiss-Prot
  Acc:Q5VTY9]
  ENSP ID: ENSP00000485903

SEQ ID NO: 69500 - protein, 493 aa, Homo sapiens; identical to SEQ ID NO: 37547
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENSP ID: ENSP00000486054

SEQ ID NO: 69501 - protein, 493 aa, Homo sapiens; identical to SEQ ID NO: 37547
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENSP ID: ENSP00000486128

SEQ ID NO: 69502 - protein, 183 aa, Homo sapiens; identical to SEQ ID NO: 37548
  Payload ID: 13784
  Gene Symbol:
  Gene Name: Protein-cysteine N-palmitoyltransferase HHAT  [Source:UniProtKB/Swiss-Prot
  Acc:Q5VTY9]
  ENSP ID: ENSP00000486378

SEQ ID NO: 69503 - protein, 494 aa, Homo sapiens; identical to SEQ ID NO: 37552
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENSP ID: ENSP00000486611

SEQ ID NO: 69504 - protein, 356 aa, Homo sapiens; identical to SEQ ID NO: 37555
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENSP ID: ENSP00000486634

SEQ ID NO: 69505 - protein, 207 aa, Homo sapiens; identical to SEQ ID NO: 37550
  Payload ID: 13784
  Gene Symbol:
  Gene Name: Protein-cysteine N-palmitoyltransferase HHAT  [Source:UniProtKB/Swiss-Prot
  Acc:Q5VTY9]
  ENSP ID: ENSP00000487124

SEQ ID NO: 69506 - protein, 493 aa, Homo sapiens; identical to SEQ ID NO: 37547
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENSP ID: ENSP00000487400

SEQ ID NO: 69507 - protein, 428 aa, Homo sapiens; identical to SEQ ID NO: 37554
  Payload ID: 13784
  Gene Symbol:
  Gene Name: Protein-cysteine N-palmitoyltransferase HHAT  [Source:UniProtKB/Swiss-Prot
  Acc:Q5VTY9]
  Uniprot ID: Q5VTY9
  ENSP ID: ENSP00000487414

SEQ ID NO: 69508 - protein, 761 aa, Homo sapiens
  Payload ID: 13785
  Gene Symbol: PRKRIR
  Gene Name: protein-kinase, interferon-inducible double stranded RNA dependent inhibitor, repressor of (P58 repressor)
  Uniprot ID: O43422
  ENSP ID: ENSP00000260045
MPNFCAAPNCTRKSTQSDLAFFRFPRDPARCQKWVENCRRADLEDKTPDQLNKHYRLCAKHFETSMICRTSPYRTVLRDNAIPTIFDLTSHLNNPHSRHRKRIKELSEDEIRTLKQKKIDETSEQEQKHKETNNSNAQNPSEEEGEGQDEDILPLTLEEKENKEYLKSLFEILILMGKQNIPLDGHEADEIPEGLFTPDNFQALLECRINSGEEVLRKRFETTAVNTLFCSKTQQRQMLEICESCIREETLREVRDSHFFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKNLQGQTSDVFFAAGSLTAVLHSLNEVMENIEVYHEFWFEEATNLATKLDIQMKLPGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 69509 - protein, 79 aa, Homo sapiens
  Payload ID: 13785
  Gene Symbol: PRKRIR
  Gene Name: protein-kinase, interferon-inducible double stranded RNA dependent inhibitor, repressor of (P58 repressor)
  ENSP ID: ENSP00000433966
MPNFCAAPNCTRKSTQSDLAFFRFPRDPARCQKWVENCRRADLEDKTPDQLNKHYRLCAKHFETSMICRTIHFAEASEN

SEQ ID NO: 69510 - protein, 285 aa, Homo sapiens
  Payload ID: 13786
  Gene Symbol: PCMT1
  Gene Name: protein-L-isoaspartate (D-aspartate) O-methyltransferase
  ENSP ID: ENSP00000356348
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 69511 - protein, 250 aa, Homo sapiens
  Payload ID: 13786
  Gene Symbol: PCMT1
  Gene Name: protein-L-isoaspartate (D-aspartate) O-methyltransferase
  Uniprot ID: P22061
  ENSP ID: ENSP00000356350
MPGARSGGSGGDGSNSGSYSGDASGAVTVWEVVSLLGKLLGTVVALKVVLYLLRVCLAMAWKSGGASHSELIHNLRSFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 69512 - protein, 286 aa, Homo sapiens
  Payload ID: 13786
  Gene Symbol: PCMT1
  Gene Name: protein-L-isoaspartate (D-aspartate) O-methyltransferase
  ENSP ID: ENSP00000356354
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRDEL

SEQ ID NO: 69513 - protein, 130 aa, Homo sapiens
  Payload ID: 13786
  Gene Symbol: PCMT1
  Gene Name: protein-L-isoaspartate (D-aspartate) O-methyltransferase
  ENSP ID: ENSP00000417112
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIADSTGEEIFSCRTLEGLFY

SEQ ID NO: 69514 - protein, 124 aa, Homo sapiens
  Payload ID: 13786
  Gene Symbol: PCMT1
  Gene Name: protein-L-isoaspartate (D-aspartate) O-methyltransferase
  ENSP ID: ENSP00000417448
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFAELLSLGSGRL

SEQ ID NO: 69515 - protein, 67 aa, Homo sapiens
  Payload ID: 13786
  Gene Symbol: PCMT1
  Gene Name: protein-L-isoaspartate (D-aspartate) O-methyltransferase
  ENSP ID: ENSP00000418461
  MOD_RES (1)..(1): Any amino acid
XEVVSLLGKLLGTVVALKVVLYLLRVCLAMAWKSGGASHSELIHNLRSMMAHTCNTSTLGGRGRWIT

SEQ ID NO: 69516 - protein, 96 aa, Homo sapiens
  Payload ID: 13786
  Gene Symbol: PCMT1
  Gene Name: protein-L-isoaspartate (D-aspartate) O-methyltransferase
  ENSP ID: ENSP00000418881
MLATDRSHYAKCNPYMDSPQSIGFQATISAPHMHAYALELLFDQLHEGAKALDVGSGSGILTACFARMVGCTGKVIGIDHIKELVDDSVNNVRKDD

SEQ ID NO: 69517 - protein, 120 aa, Homo sapiens
  Payload ID: 13786
  Gene Symbol: PCMT1
  Gene Name: protein-L-isoaspartate (D-aspartate) O-methyltransferase
  ENSP ID: ENSP00000420804
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIESPVFNSFS

SEQ ID NO: 69518 - protein, 285 aa, Homo sapiens; identical to SEQ ID NO: 69510
  Payload ID: 13786
  Gene Symbol: PCMT1
  Gene Name: protein-L-isoaspartate (D-aspartate) O-methyltransferase
  ENSP ID: ENSP00000420813

SEQ ID NO: 69519 - protein, 250 aa, Homo sapiens
  Payload ID: 13786
  Gene Symbol: PCMT1
  Gene Name: protein-L-isoaspartate (D-aspartate) O-methyltransferase
  ENSP ID: ENSP00000438247
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 69520 - protein, 357 aa, Homo sapiens
  Payload ID: 13787
  Gene Symbol: PCMTD1
  Gene Name: protein-L-isoaspartate (D-aspartate) O-methyltransferase domain containing 1
  Uniprot ID: Q96MG8
  ENSP ID: ENSP00000353739
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDKFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDNKEEEEKDHNEAMKPEEPPQNLLREKIMKLPLPESLKAYLTYFRDK

SEQ ID NO: 69521 - protein, 357 aa, Homo sapiens; identical to SEQ ID NO: 69520
  Payload ID: 13787
  Gene Symbol: PCMTD1
  Gene Name: protein-L-isoaspartate (D-aspartate) O-methyltransferase domain containing 1
  Uniprot ID: Q96MG8
  ENSP ID: ENSP00000428099

SEQ ID NO: 69522 - protein, 105 aa, Homo sapiens
  Payload ID: 13787
  Gene Symbol: PCMTD1
  Gene Name: protein-L-isoaspartate (D-aspartate) O-methyltransferase domain containing 1
  ENSP ID: ENSP00000430168
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMYFDLRVLN

SEQ ID NO: 69523 - protein, 130 aa, Homo sapiens
  Payload ID: 13787
  Gene Symbol: PCMTD1
  Gene Name: protein-L-isoaspartate (D-aspartate) O-methyltransferase domain containing 1
  ENSP ID: ENSP00000430340
  MOD_RES (1)..(1): Any amino acid
XGIELHSDVVEYAKEKLESFIKNSDSFDKFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLHLG

SEQ ID NO: 69524 - protein, 281 aa, Homo sapiens
  Payload ID: 13787
  Gene Symbol: PCMTD1
  Gene Name: protein-L-isoaspartate (D-aspartate) O-methyltransferase domain containing 1
  ENSP ID: ENSP00000444026
MPGPRRLRSPGGSGCSSRGSGPRLSTRRWRPCCYCGGSGVWLLRTPPSPSAWPARRCPRHRFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDNKEEEEKDHNEAMKPEEPPQNLLREKIMKLPLPESLKAYLTYFRDK

SEQ ID NO: 69525 - protein, 282 aa, Homo sapiens
  Payload ID: 13788
  Gene Symbol: PCMTD2
  Gene Name: protein-L-isoaspartate (D-aspartate) O-methyltransferase domain containing 2
  ENSP ID: ENSP00000299468
MGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLRSPSFVQGWSVVVLSQLTAASTFQAEAILPSQSPTWLTLQVLATMPN

SEQ ID NO: 69526 - protein, 361 aa, Homo sapiens
  Payload ID: 13788
  Gene Symbol: PCMTD2
  Gene Name: protein-L-isoaspartate (D-aspartate) O-methyltransferase domain containing 2
  Uniprot ID: Q9NV79
  ENSP ID: ENSP00000307854
MGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 69527 - protein, 334 aa, Homo sapiens
  Payload ID: 13788
  Gene Symbol: PCMTD2
  Gene Name: protein-L-isoaspartate (D-aspartate) O-methyltransferase domain containing 2
  Uniprot ID: Q9NV79
  ENSP ID: ENSP00000358773
MGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSFDKFDFCEPSFVTGNCLEISPDCSQYDRVYCGAGVQKEHEEYMKNLLKVGGILVMPLEEKPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 69528 - protein, 183 aa, Homo sapiens
  Payload ID: 13788
  Gene Symbol: PCMTD2
  Gene Name: protein-L-isoaspartate (D-aspartate) O-methyltransferase domain containing 2
  ENSP ID: ENSP00000476726
NNFLHFTNEETEAGTGEGDAGSRTCPSWGQKLTQLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVL

SEQ ID NO: 69529 - protein, 94 aa, Homo sapiens
  Payload ID: 13788
  Gene Symbol: PCMTD2
  Gene Name: protein-L-isoaspartate (D-aspartate) O-methyltransferase domain containing 2
  ENSP ID: ENSP00000476878
MGGAVSAGEDNDELIDNLKEAQYIRTELVEQAFRAIDRADYYLEEFKENAYKDLAWKHGNIHLSAPCIYSEVMEALDLQPGLSFLNLGSGTGYL

SEQ ID NO: 69530 - protein, 135 aa, Homo sapiens
  Payload ID: 13788
  Gene Symbol: PCMTD2
  Gene Name: protein-L-isoaspartate (D-aspartate) O-methyltransferase domain containing 2
  ENSP ID: ENSP00000477110
MGGAVSAGEDNDELIDNLKEAQYIRTELVEQAFRAIDRADYYLEEFKENAYKDLAWKHGNIHLSAPCIYSEVMEALDLQPGLSFLNLGSGTGYLSSMVGLILGPFGVNHGVELHSDVIEYAKQKLDFFIRTSDSF

SEQ ID NO: 69531 - protein, 71 aa, Homo sapiens
  Payload ID: 13788
  Gene Symbol: PCMTD2
  Gene Name: protein-L-isoaspartate (D-aspartate) O-methyltransferase domain containing 2
  ENSP ID: ENSP00000477240
  MOD_RES (1)..(1): Any amino acid
XYYLEEFKENAYKDLAWKHGNIHLSAPCIYSEVMEALDLQPGLSFLNLGSGTGYLSSMVGLILDAAAFIQA

SEQ ID NO: 69532 - protein, 135 aa, Homo sapiens; identical to SEQ ID NO: 69530
  Payload ID: 13788
  Gene Symbol: PCMTD2
  Gene Name: protein-L-isoaspartate (D-aspartate) O-methyltransferase domain containing 2
  ENSP ID: ENSP00000477252

SEQ ID NO: 69533 - protein, 211 aa, Homo sapiens
  Payload ID: 13788
  Gene Symbol: PCMTD2
  Gene Name: protein-L-isoaspartate (D-aspartate) O-methyltransferase domain containing 2
  ENSP ID: ENSP00000477398
MGGAVSAGEDNDELIDNLKEAQYIRTELVEQAFRAIDRADYYLEEFKENAYKDLAWKHGNIHLSAPCIYSEPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 69534 - protein, 262 aa, Homo sapiens
  Payload ID: 13788
  Gene Symbol: PCMTD2
  Gene Name: protein-L-isoaspartate (D-aspartate) O-methyltransferase domain containing 2
  ENSP ID: ENSP00000478638
MEAWKHSPLSPVELHSDVIEYAKQKLDFFIRTSDSFDKFDFCEPSFVTGNCLEISPDCSQYDRVYCGAGVQKEHEEYMKNLLKVGGILVMPLEEKLTKITRTGPSAWETKKILAVSFAPLIQPCHSESGKSRLVQLPPVAVRSLQDLARIAIRGTIKKIIHQETVSKNGNGLKNTPRFKRRRVRRRRMETIVFLDKEVFASRISNPSDDNSCEDLEEERREEEEKTPPETKPDPPVNFLRQKVLSLPLPDPLKYYLLYYREK

SEQ ID NO: 69535 - protein, 135 aa, Homo sapiens; identical to SEQ ID NO: 69530
  Payload ID: 13788
  Gene Symbol: PCMTD2
  Gene Name: protein-L-isoaspartate (D-aspartate) O-methyltransferase domain containing 2
  ENSP ID: ENSP00000485733

SEQ ID NO: 69536 - protein, 334 aa, Homo sapiens; identical to SEQ ID NO: 69527
  Payload ID: 13788
  Gene Symbol: PCMTD2
  Gene Name: protein-L-isoaspartate (D-aspartate) O-methyltransferase domain containing 2
  Uniprot ID: Q9NV79
  ENSP ID: ENSP00000486003

SEQ ID NO: 69537 - protein, 31 aa, Homo sapiens
  Payload ID: 13788
  Gene Symbol: PCMTD2
  Gene Name: protein-L-isoaspartate (D-aspartate) O-methyltransferase domain containing 2
  ENSP ID: ENSP00000486313
MGGAVSAGEDNDELIDNLKEAQYIRTELVEQ

SEQ ID NO: 69538 - protein, 135 aa, Homo sapiens; identical to SEQ ID NO: 69530
  Payload ID: 13788
  Gene Symbol: PCMTD2
  Gene Name: protein-L-isoaspartate (D-aspartate) O-methyltransferase domain containing 2
  ENSP ID: ENSP00000486493

SEQ ID NO: 69539 - protein, 361 aa, Homo sapiens; identical to SEQ ID NO: 69526
  Payload ID: 13788
  Gene Symbol: PCMTD2
  Gene Name: protein-L-isoaspartate (D-aspartate) O-methyltransferase domain containing 2
  Uniprot ID: Q9NV79
  ENSP ID: ENSP00000486510

SEQ ID NO: 69540 - protein, 94 aa, Homo sapiens; identical to SEQ ID NO: 69529
  Payload ID: 13788
  Gene Symbol: PCMTD2
  Gene Name: protein-L-isoaspartate (D-aspartate) O-methyltransferase domain containing 2
  ENSP ID: ENSP00000486648

SEQ ID NO: 69541 - protein, 211 aa, Homo sapiens; identical to SEQ ID NO: 69533
  Payload ID: 13788
  Gene Symbol: PCMTD2
  Gene Name: protein-L-isoaspartate (D-aspartate) O-methyltransferase domain containing 2
  ENSP ID: ENSP00000487463

SEQ ID NO: 69542 - protein, 361 aa, Homo sapiens; identical to SEQ ID NO: 69526
  Payload ID: 13789
  Gene Symbol:
  Gene Name: Protein-L-isoaspartate O-methyltransferase domain-containing protein 2  [Source:UniProtKB/Swiss-Prot
  Acc:Q9NV79]
  Uniprot ID: Q9NV79
  ENSP ID: ENSP00000482166

SEQ ID NO: 69543 - protein, 829 aa, Homo sapiens
  Payload ID: 13789
  Gene Symbol:
  Gene Name: Protein-L-isoaspartate O-methyltransferase domain-containing protein 2  [Source:UniProtKB/Swiss-Prot
  Acc:Q9NV79]
  ENSP ID: ENSP00000487346
EEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 69544 - protein, 350 aa, Homo sapiens
  Payload ID: 13790
  Gene Symbol: POMK
  Gene Name: protein-O-mannose kinase
  Uniprot ID: Q9H5K3
  ENSP ID: ENSP00000331258
MEKQPQNSRRGLAPREVPPAVGLLLIMALMNTLLYLCLDHFFIAPRQSTVDPTHCPYGHFRIGQMKNCSPWLSCEELRTEVRQLKRVGEGAVKRVFLSEWKEHKVALSQLTSLEMKDDFLHGLQMLKSLQGTHVVTLLGYCEDDNTMLTEYHPLGSLSNLEETLNLSKYQNVNTWQHRLELAMDYVSIINYLHHSPVGTRVMCDSNDLPKTLSQYLLTSNFSILANDLDALPLVNHSSGMLVKCGHRELHGDFVAPEQLWPYGEDVPFHDDLMPSYDEKIDIWKIPDISSFLLGHIEGSDMVRFHLFDIHKACKSQTPSERPTAQDVLETYQKVLDTLRDAMMSQAREML

SEQ ID NO: 69545 - protein, 134 aa, Homo sapiens
  Payload ID: 13790
  Gene Symbol: POMK
  Gene Name: protein-O-mannose kinase
  ENSP ID: ENSP00000429090
MEKQPQNSRRGLAPREVPPAVGLLLIMALMNTLLYLCLDHFFIAPRQSTVDPTHCPYGHFRIGQMKNCSPWLSCEELRTEVRQLKRVGEGAVKRVFLSEWKEHKVALSQLTSLEMKDDFLHGLQMLKSLQGTHV

SEQ ID NO: 69546 - protein, 350 aa, Homo sapiens; identical to SEQ ID NO: 69544
  Payload ID: 13790
  Gene Symbol: POMK
  Gene Name: protein-O-mannose kinase
  Uniprot ID: Q9H5K3
  ENSP ID: ENSP00000478821

SEQ ID NO: 69547 - protein, 671 aa, Homo sapiens
  Payload ID: 13791
  Gene Symbol: POMT1
  Gene Name: protein-O-mannosyltransferase 1
  Uniprot ID: Q9Y6A1
  ENSP ID: ENSP00000343034
MKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 69548 - protein, 346 aa, Homo sapiens
  Payload ID: 13791
  Gene Symbol: POMT1
  Gene Name: protein-O-mannosyltransferase 1
  ENSP ID: ENSP00000361294
WRGGGCTSPATLGAARGAVGIGKEGQYQPLIASLTWGLVPLSQAQEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 69549 - protein, 747 aa, Homo sapiens
  Payload ID: 13791
  Gene Symbol: POMT1
  Gene Name: protein-O-mannosyltransferase 1
  Uniprot ID: Q9Y6A1
  ENSP ID: ENSP00000361302
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMQMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 69550 - protein, 608 aa, Homo sapiens
  Payload ID: 13791
  Gene Symbol: POMT1
  Gene Name: protein-O-mannosyltransferase 1
  Uniprot ID: Q9Y6A1
  ENSP ID: ENSP00000384531
MAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 69551 - protein, 725 aa, Homo sapiens
  Payload ID: 13791
  Gene Symbol: POMT1
  Gene Name: protein-O-mannosyltransferase 1
  Uniprot ID: Q9Y6A1
  ENSP ID: ENSP00000385797
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 69552 - protein, 142 aa, Homo sapiens
  Payload ID: 13791
  Gene Symbol: POMT1
  Gene Name: protein-O-mannosyltransferase 1
  ENSP ID: ENSP00000390737
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLI

SEQ ID NO: 69553 - protein, 296 aa, Homo sapiens
  Payload ID: 13791
  Gene Symbol: POMT1
  Gene Name: protein-O-mannosyltransferase 1
  ENSP ID: ENSP00000395060
MAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMQMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLN

SEQ ID NO: 69554 - protein, 168 aa, Homo sapiens
  Payload ID: 13791
  Gene Symbol: POMT1
  Gene Name: protein-O-mannosyltransferase 1
  ENSP ID: ENSP00000402083
MAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLE

SEQ ID NO: 69555 - protein, 218 aa, Homo sapiens
  Payload ID: 13791
  Gene Symbol: POMT1
  Gene Name: protein-O-mannosyltransferase 1
  ENSP ID: ENSP00000403736
MKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMQMSQGVCVFCHLLARAVALLVI

SEQ ID NO: 69556 - protein, 725 aa, Homo sapiens; identical to SEQ ID NO: 69551
  Payload ID: 13791
  Gene Symbol: POMT1
  Gene Name: protein-O-mannosyltransferase 1
  Uniprot ID: Q9Y6A1
  ENSP ID: ENSP00000404119

SEQ ID NO: 69557 - protein, 156 aa, Homo sapiens
  Payload ID: 13791
  Gene Symbol: POMT1
  Gene Name: protein-O-mannosyltransferase 1
  ENSP ID: ENSP00000405149
MAYQIVLELHFSHCAAMGAALLMLIENALITQSRLMLLESVLIFFNLLAVLSYLKFFNCQKHSLPLWAPRPNHVQCLPGQLRGRTSSDHSGSATGGGLWVPGHSEERLWETCALLASFPPGHLPHDVRYENGRGSSHQQQVTCYPFKDVNNWWIVK

SEQ ID NO: 69558 - protein, 750 aa, Homo sapiens
  Payload ID: 13792
  Gene Symbol: POMT2
  Gene Name: protein-O-mannosyltransferase 2
  Uniprot ID: Q9UKY4
  ENSP ID: ENSP00000261534
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSFYLFHPLAYGMVGPLAQDPQSPMAGLRWLDSWDF

SEQ ID NO: 69559 - protein, 82 aa, Homo sapiens
  Payload ID: 13792
  Gene Symbol: POMT2
  Gene Name: protein-O-mannosyltransferase 2
  Uniprot ID: Q9UKY4
  ENSP ID: ENSP00000450630
MPPATGGGLAESELRPRRGRCGPQAARAAGRDVAAEAVARSPKRPAWGSRRFEAVGWWALLALVTLLSFATRFHRLDEPPHI

SEQ ID NO: 69560 - protein, 52 aa, Homo sapiens
  Payload ID: 13792
  Gene Symbol: POMT2
  Gene Name: protein-O-mannosyltransferase 2
  ENSP ID: ENSP00000451115
DLSKSLSAALLTAALLTFGDCGKTPDCSCPVPHSAAPGSLYSHLCCSLHGAE

SEQ ID NO: 69561 - protein, 193 aa, Homo sapiens
  Payload ID: 13792
  Gene Symbol: POMT2
  Gene Name: protein-O-mannosyltransferase 2
  ENSP ID: ENSP00000451651
  MOD_RES (1)..(1): Any amino acid
XLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGQVLWALPPLTWRQQGTCTPGEGRLPADGPSFAFTTPHLPLSFAFERKPRNHEIKKLAPGHTARLSQVLLRGGGQVLLGWTLHYFPFFLMGRVLY

SEQ ID NO: 69562 - protein, 75 aa, Homo sapiens
  Payload ID: 13792
  Gene Symbol: POMT2
  Gene Name: protein-O-mannosyltransferase 2
  ENSP ID: ENSP00000451730
RFSGVNDTDFRVYLLGNPVVWWLNLLSIALYLLSGSIIAVAMQRGARLPAEVAGHTARKGQSWTRAWNLCPLLVF

SEQ ID NO: 69563 - protein, 102 aa, Homo sapiens
  Payload ID: 13792
  Gene Symbol: POMT2
  Gene Name: protein-O-mannosyltransferase 2
  ENSP ID: ENSP00000451967
  MOD_RES (1)..(1): Any amino acid
XLSIALYLLSGSIIAVAMQRGARLPAEVAGILWDTLLRLCAWGLASWPLARGIHVAGILSLLLGTAYSFYLFHPLAYGMVGPLAQDPQSPMAGLRWLDSWDF

SEQ ID NO: 69564 - protein, 137 aa, Homo sapiens
  Payload ID: 13792
  Gene Symbol: POMT2
  Gene Name: protein-O-mannosyltransferase 2
  ENSP ID: ENSP00000452060
MGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFW

SEQ ID NO: 69565 - protein, 219 aa, Homo sapiens
  Payload ID: 13792
  Gene Symbol: POMT2
  Gene Name: protein-O-mannosyltransferase 2
  ENSP ID: ENSP00000487704
VVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYRSPKNSAAHQDPALGVQLEWNPALERAGREPQLRPQHHGEDSASWAAPSCTAQGRMGARGWEWVRVCVCEGMLSISLWNTDRVTGQLSVINSKIVQAIV

SEQ ID NO: 69566 - protein, 222 aa, Homo sapiens
  Payload ID: 13793
  Gene Symbol: PRG2
  Gene Name: proteoglycan 2, bone marrow (natural killer cell activator, eosinophil granule major basic protein)
  Uniprot ID: P13727
  ENSP ID: ENSP00000312134
MKLPLLLALLFGAVSALHLRSETSTFETPLGAKTLPEDEETPEQEMEETPCRELEEEEEWGSGSEDASKKDGAVESISVPDMVDKNLTCPEEEDTVKVVGIPGCQTCRYLLVRSLQTFSQAWFTCRRCYRGNLVSIHNFNINYRIQCSVSALNQGQVWIGGRITGSGRCRRFQWVDGSRWNFAYWAAHQPWSRGGHCVALCTRGGHWRRAHCLRRLPFICSY

SEQ ID NO: 69567 - protein, 222 aa, Homo sapiens; identical to SEQ ID NO: 69566
  Payload ID: 13793
  Gene Symbol: PRG2
  Gene Name: proteoglycan 2, bone marrow (natural killer cell activator, eosinophil granule major basic protein)
  Uniprot ID: P13727
  ENSP ID: ENSP00000433016

SEQ ID NO: 69568 - protein, 211 aa, Homo sapiens
  Payload ID: 13793
  Gene Symbol: PRG2
  Gene Name: proteoglycan 2, bone marrow (natural killer cell activator, eosinophil granule major basic protein)
  Uniprot ID: P13727
  ENSP ID: ENSP00000433231
MKLPLLLALLFGAVSALHLRSETSTFETPLGAKTLPEDEETPEQEMEETPCRELEEEEEWGSGSEDASKKDGAVESISVPDMVDKNLTCPEEEDTVKVVGIPGCQTCRYLLFTCRRCYRGNLVSIHNFNINYRIQCSVSALNQGQVWIGGRITGSGRCRRFQWVDGSRWNFAYWAAHQPWSRGGHCVALCTRGGHWRRAHCLRRLPFICSY

SEQ ID NO: 69569 - protein, 225 aa, Homo sapiens
  Payload ID: 13794
  Gene Symbol: PRG3
  Gene Name: proteoglycan 3
  Uniprot ID: Q9Y2Y8
  ENSP ID: ENSP00000287143
MQCLLLLPFLLLGTVSALHLENDAPHLESLETQADLGQDLDSSKEQERDLALTEEVIQAEGEEVKASACQDNFEDEEAMESDPAALDKDFQCPREEDIVEVQGSPRCKICRYLLVRTPKTFAEAQNVCSRCYGGNLVSIHDFNFNYRIQCCTSTVNQAQVWIGGNLRGWFLWKRFCWTDGSHWNFAYWSPGQPGNGQGSCVALCTKGGYWRRAQCDKQLPFVCSF

SEQ ID NO: 69570 - protein, 853 aa, Homo sapiens
  Payload ID: 13795
  Gene Symbol: PRG4
  Gene Name: proteoglycan 4
  ENSP ID: ENSP00000356452
MAWKTLPIYLLLLLSVFVIQQVSSQELSCKGRCFESFERGRECDCDAQCKKYDKCCPDYESFCAEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTT

SEQ ID NO: 69571 - protein, 1363 aa, Homo sapiens
  Payload ID: 13795
  Gene Symbol: PRG4
  Gene Name: proteoglycan 4
  Uniprot ID: Q92954
  ENSP ID: ENSP00000356453
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 69572 - protein, 1311 aa, Homo sapiens
  Payload ID: 13795
  Gene Symbol: PRG4
  Gene Name: proteoglycan 4
  Uniprot ID: Q92954
  ENSP ID: ENSP00000356455
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 69573 - protein, 1404 aa, Homo sapiens
  Payload ID: 13795
  Gene Symbol: PRG4
  Gene Name: proteoglycan 4
  Uniprot ID: Q92954
  ENSP ID: ENSP00000399679
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 69574 - protein, 162 aa, Homo sapiens
  Payload ID: 13795
  Gene Symbol: PRG4
  Gene Name: proteoglycan 4
  ENSP ID: ENSP00000431330
MAWKTLPIYLLLLLSVFVIQQVSSQELSCKGRCFESFERGRECDCDAQCKKYDKCCPDYESFCAEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKIT

SEQ ID NO: 69575 - protein, 1361 aa, Homo sapiens
  Payload ID: 13795
  Gene Symbol: PRG4
  Gene Name: proteoglycan 4
  ENSP ID: ENSP00000489292
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTSDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 69576 - protein, 111 aa, Homo sapiens
  Payload ID: 13796
  Gene Symbol: PLP1
  Gene Name: proteolipid protein 1
  ENSP ID: ENSP00000391853
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGK

SEQ ID NO: 69577 - protein, 100 aa, Homo sapiens
  Payload ID: 13796
  Gene Symbol: PLP1
  Gene Name: proteolipid protein 1
  ENSP ID: ENSP00000393391
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQI

SEQ ID NO: 69578 - protein, 122 aa, Homo sapiens
  Payload ID: 13796
  Gene Symbol: PLP1
  Gene Name: proteolipid protein 1
  ENSP ID: ENSP00000403335
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQK

SEQ ID NO: 69579 - protein, 136 aa, Homo sapiens
  Payload ID: 13796
  Gene Symbol: PLP1
  Gene Name: proteolipid protein 1
  ENSP ID: ENSP00000409802
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLE

SEQ ID NO: 69580 - protein, 127 aa, Homo sapiens
  Payload ID: 13796
  Gene Symbol: PLP1
  Gene Name: proteolipid protein 1
  ENSP ID: ENSP00000413931
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSR

SEQ ID NO: 69581 - protein, 242 aa, Homo sapiens
  Payload ID: 13796
  Gene Symbol: PLP1
  Gene Name: proteolipid protein 1
  Uniprot ID: P60201
  ENSP ID: ENSP00000477619
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 69582 - protein, 136 aa, Homo sapiens; identical to SEQ ID NO: 69579
  Payload ID: 13796
  Gene Symbol: PLP1
  Gene Name: proteolipid protein 1
  ENSP ID: ENSP00000480409

SEQ ID NO: 69583 - protein, 277 aa, Homo sapiens
  Payload ID: 13796
  Gene Symbol: PLP1
  Gene Name: proteolipid protein 1
  Uniprot ID: P60201
  ENSP ID: ENSP00000481006
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 69584 - protein, 277 aa, Homo sapiens; identical to SEQ ID NO: 69583
  Payload ID: 13796
  Gene Symbol: PLP1
  Gene Name: proteolipid protein 1
  Uniprot ID: P60201
  ENSP ID: ENSP00000484450

SEQ ID NO: 69585 - protein, 145 aa, Homo sapiens
  Payload ID: 13797
  Gene Symbol: PLP2
  Gene Name: proteolipid protein 2 (colonic epithelium-enriched)
  Uniprot ID: Q04941
  ENSP ID: ENSP00000365500
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVKAMGAALKHRAKGLRSQGPFLPLLLAEIV

SEQ ID NO: 69586 - protein, 152 aa, Homo sapiens
  Payload ID: 13797
  Gene Symbol: PLP2
  Gene Name: proteolipid protein 2 (colonic epithelium-enriched)
  Uniprot ID: Q04941
  ENSP ID: ENSP00000365505
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVLGLIATCLFGYDAYVTFPVRQPRHTAAPTDPADGPV

SEQ ID NO: 69587 - protein, 111 aa, Homo sapiens
  Payload ID: 13798
  Gene Symbol: PTMA
  Gene Name: prothymosin, alpha
  Uniprot ID: P06454
  ENSP ID: ENSP00000344547
MSDAAVDTSSEITTKDLKEKKEVVEEAENGRDAPANGNAENEENGEQEADNEVDEEEEEGGEEEEEEEEGDGEEEDGDEDEEAESATGKRAAEDDEDDDVDTKKQKTDEDD

SEQ ID NO: 69588 - protein, 107 aa, Homo sapiens
  Payload ID: 13798
  Gene Symbol: PTMA
  Gene Name: prothymosin, alpha
  ENSP ID: ENSP00000386519
MSDAAVDTSSEITTKDLKEKKEVVEEAENGRDAPANGNANEENGEQEADNEVDEEEEEGGEEEEEEEEGDEDGDEDEEAESATGKRAAEDDEDDDVDTKKQKTDEDD

SEQ ID NO: 69589 - protein, 131 aa, Homo sapiens
  Payload ID: 13798
  Gene Symbol: PTMA
  Gene Name: prothymosin, alpha
  ENSP ID: ENSP00000386645
MNPCVLGTVPACRLTWPTDAGPDDAAVDTSSEITTKDLKEKKEVVEEAENGRDAPANGNANEENGEQEADNEVDEEEEEGGEEEEEEEEGDGEEEDGDEDEEAESATGKRAAEDDEDDDVDTKKQKTDEDD

SEQ ID NO: 69590 - protein, 110 aa, Homo sapiens
  Payload ID: 13798
  Gene Symbol: PTMA
  Gene Name: prothymosin, alpha
  Uniprot ID: P06454
  ENSP ID: ENSP00000386819
MSDAAVDTSSEITTKDLKEKKEVVEEAENGRDAPANGNANEENGEQEADNEVDEEEEEGGEEEEEEEEGDGEEEDGDEDEEAESATGKRAAEDDEDDDVDTKKQKTDEDD

SEQ ID NO: 69591 - protein, 136 aa, Homo sapiens
  Payload ID: 13798
  Gene Symbol: PTMA
  Gene Name: prothymosin, alpha
  ENSP ID: ENSP00000387102
MQTFGPAGVAAVGRRVESPADRRATRARATASSACRPGVSKDLKEKKEVVEEAENGRDAPANGNANEENGEQEADNEVDEEEEEGGEEEEEEEEGDGEEEDGDEDEEAESATGKRAAEDDEDDDVDTKKQKTDEDD

SEQ ID NO: 69592 - protein, 74 aa, Homo sapiens
  Payload ID: 13798
  Gene Symbol: PTMA
  Gene Name: prothymosin, alpha
  ENSP ID: ENSP00000392732
GAGRTERADRWPGAARRTAAEGFPQARTPDLCWYWWPCRVEKVTGRPGPRCLLDPGRSPTPEDLKEKKEVVEEA

SEQ ID NO: 69593 - protein, 43 aa, Homo sapiens
  Payload ID: 13798
  Gene Symbol: PTMA
  Gene Name: prothymosin, alpha
  ENSP ID: ENSP00000400406
MNPCVLGTVPACRLTWPTDAGPDGLKGEEGSCGRGRKWKRRPC

SEQ ID NO: 69594 - protein, 148 aa, Homo sapiens
  Payload ID: 13798
  Gene Symbol: PTMA
  Gene Name: prothymosin, alpha
  ENSP ID: ENSP00000406903
  MOD_RES (1)..(1): Any amino acid
XSPGLRPPGGESGRSRGPRSGAGRAGLRGPTGGPEPLAGQRPRGSRRPGRRTSDLKEKKEVVEEAENGRDAPANGNANEENGEQEADNEVDEEEEEGGEEEEEEEEGDGEEEDGDEDEEAESATGKRAAEDDEDDDVDTKKQKTDEDD

SEQ ID NO: 69595 - protein, 135 aa, Homo sapiens
  Payload ID: 13798
  Gene Symbol: PTMA
  Gene Name: prothymosin, alpha
  ENSP ID: ENSP00000478904
MQTFGPAGVAAVGRRVESPADRRATRARACKLCLPAGSLQGLKGEEGSVEEAENGRDAPANGNANEENGEQEADNEVDEEEEEGGEEEEEEEEGDGEEEDGDEDEEAESATGKRAAEDDEDDDVDTKKQKTDEDD

SEQ ID NO: 69596 - protein, 1237 aa, Homo sapiens
  Payload ID: 13799
  Gene Symbol: PCDH1
  Gene Name: protocadherin 1
  Uniprot ID: Q08174
  ENSP ID: ENSP00000287008
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQLPHRRVTFSATSQAQELQDPSQHSYYDSGLEESETPSSKSSSGPRLGPLALPEDHYERTTPDGSIGEMEHPENDLRPLPDVAMTGTCTRECSEFGHSDTCWMPGQSSPSRRTKSSALKLSTFVPYQDRGGQEPAGAGSPSPPEDRNTKTAPVRLLPSYSAFSHSSHDSCKDSATLEEIPLTQTSDFPPAATPASAQTAKREIYL

SEQ ID NO: 69597 - protein, 1060 aa, Homo sapiens
  Payload ID: 13799
  Gene Symbol: PCDH1
  Gene Name: protocadherin 1
  Uniprot ID: Q08174
  ENSP ID: ENSP00000378043
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQVGQPFQLSTPQPLPHPYHGAIWTEVWE

SEQ ID NO: 69598 - protein, 126 aa, Homo sapiens
  Payload ID: 13799
  Gene Symbol: PCDH1
  Gene Name: protocadherin 1
  ENSP ID: ENSP00000424004
  MOD_RES (1)..(1): Any amino acid
XGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQSLVDWDLEKRLRKKRETDSRG

SEQ ID NO: 69599 - protein, 150 aa, Homo sapiens
  Payload ID: 13799
  Gene Symbol: PCDH1
  Gene Name: protocadherin 1
  ENSP ID: ENSP00000424163
MEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPV

SEQ ID NO: 69600 - protein, 17 aa, Homo sapiens
  Payload ID: 13799
  Gene Symbol: PCDH1
  Gene Name: protocadherin 1
  ENSP ID: ENSP00000424204
  MOD_RES (1)..(1): Any amino acid
XIQVRGPLRITVRVTHH

SEQ ID NO: 69601 - protein, 382 aa, Homo sapiens
  Payload ID: 13799
  Gene Symbol: PCDH1
  Gene Name: protocadherin 1
  ENSP ID: ENSP00000424667
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQLPHRRVTFSATSQAQELQDPSQHSYYDSGLEESETPSSKSSSGPRLGPLALPEDHYERTTPDGSIGEMEHPENEPAGRSRP

SEQ ID NO: 69602 - protein, 1040 aa, Homo sapiens
  Payload ID: 13800
  Gene Symbol: PCDH10
  Gene Name: protocadherin 10
  Uniprot ID: Q9P2E7
  ENSP ID: ENSP00000264360
MIVLLLFALLWMVEGVFSQLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVYTVSLPENSPPGTLVIQLNATDPDEGQNGEVVYSFSSHISPRARELFGLSPRTGRLEVSGELDYEESPVYQVYVQAKDLGPNAVPAHCKVLVRVLDANDNAPEISFSTVKEAVSEGAAPGTVVALFSVTDRDSEENGQVQCELLGDVPFRLKSSFKNYYTIVTEAPLDREAGDSYTLTVVARDRGEPALSTSKSIQVQVSDVNDNAPRFSQPVYDVYVTENNVPGAYIYAVSATDRDEGANAQLAYSILECQIQGMSVFTYVSINSENGYLYALRSFDYEQLKDFSFQVEARDAGSPQALAGNATVNILIVDQNDNAPAIVAPLPGRNGTPAREVLPRSAEPGYLLTRVAAVDADDGENARLTYSIVRGNEMNLFRMDWRTGELRTARRVPAKRDPQRPYELVIEVRDHGQPPLSSTATLVVQLVDGAVEPQGGGGSGGGGSGEHQRPSRSGGGETSLDLTLILIIALGSVSFIFLLAMIVLAVRCQKEKKLNIYTCLASDCCLCCCCCGGGGSTCCGRQARARKKKLSKSDIMLVQSSNVPSNPAQVPIEESGGFGSHHHNQNYCYQVCLTPESAKTDLMFLKPCSPSRSTDTEHNPCGAIVTGYTDQQPDIISNGSILSNETKHQRAELSYLVDRPRRVNSSAFQEADIVSSKDSGHGDSEQGDSDHDATNRAQSAGMDLFSNCTEECKALGHSDRCWMPSFVPSDGRQAADYRSNLHVPGMDSVPDTEVFETPEAQPGAERSFSTFGKEKALHSTLERKELDGLLTNTRAPYKPPYLTRKRIC

SEQ ID NO: 69603 - protein, 896 aa, Homo sapiens
  Payload ID: 13800
  Gene Symbol: PCDH10
  Gene Name: protocadherin 10
  Uniprot ID: Q9P2E7
  ENSP ID: ENSP00000480512
MIVLLLFALLWMVEGVFSQLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVYTVSLPENSPPGTLVIQLNATDPDEGQNGEVVYSFSSHISPRARELFGLSPRTGRLEVSGELDYEESPVYQVYVQAKDLGPNAVPAHCKVLVRVLDANDNAPEISFSTVKEAVSEGAAPGTVVALFSVTDRDSEENGQVQCELLGDVPFRLKSSFKNYYTIVTEAPLDREAGDSYTLTVVARDRGEPALSTSKSIQVQVSDVNDNAPRFSQPVYDVYVTENNVPGAYIYAVSATDRDEGANAQLAYSILECQIQGMSVFTYVSINSENGYLYALRSFDYEQLKDFSFQVEARDAGSPQALAGNATVNILIVDQNDNAPAIVAPLPGRNGTPAREVLPRSAEPGYLLTRVAAVDADDGENARLTYSIVRGNEMNLFRMDWRTGELRTARRVPAKRDPQRPYELVIEVRDHGQPPLSSTATLVVQLVDGAVEPQGGGGSGGGGSGEHQRPSRSGGGETSLDLTLILIIALGSVSFIFLLAMIVLAVRCQKEKKLNIYTCLASDCCLCCCCCGGGGSTCCGRQARARKKKLSKSDIMLVQSSNVPSNPAQVPIEESGGFGSHHHNQNYCYQVCLTPESAKTDLMFLKPCSPSRSTDTEHNPCGAIVTGYTDQQPDIISNGSILSNEVRLKRKDHHLSSPPSESLL

SEQ ID NO: 69604 - protein, 1329 aa, Homo sapiens
  Payload ID: 13801
  Gene Symbol: PCDH11X
  Gene Name: protocadherin 11 X-linked
  Uniprot ID: Q9BZA7
  ENSP ID: ENSP00000355105
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQSQRRVTFHLPEGSQESSSDGGLGDHDAGSLTSTSHGLPLGYPQEEYFDRATPSNRTEGDGNSDPESTAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 69605 - protein, 1310 aa, Homo sapiens
  Payload ID: 13801
  Gene Symbol: PCDH11X
  Gene Name: protocadherin 11 X-linked
  Uniprot ID: Q9BZA7
  ENSP ID: ENSP00000362180
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 69606 - protein, 1347 aa, Homo sapiens
  Payload ID: 13801
  Gene Symbol: PCDH11X
  Gene Name: protocadherin 11 X-linked
  Uniprot ID: Q9BZA7
  ENSP ID: ENSP00000362186
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 69607 - protein, 1337 aa, Homo sapiens
  Payload ID: 13801
  Gene Symbol: PCDH11X
  Gene Name: protocadherin 11 X-linked
  Uniprot ID: Q9BZA7
  ENSP ID: ENSP00000362189
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 69608 - protein, 1016 aa, Homo sapiens
  Payload ID: 13801
  Gene Symbol: PCDH11X
  Gene Name: protocadherin 11 X-linked
  ENSP ID: ENSP00000378746
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPAQRKL

SEQ ID NO: 69609 - protein, 1339 aa, Homo sapiens
  Payload ID: 13801
  Gene Symbol: PCDH11X
  Gene Name: protocadherin 11 X-linked
  Uniprot ID: Q9BZA7
  ENSP ID: ENSP00000384758
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 69610 - protein, 1065 aa, Homo sapiens
  Payload ID: 13801
  Gene Symbol: PCDH11X
  Gene Name: protocadherin 11 X-linked
  Uniprot ID: Q9BZA7
  ENSP ID: ENSP00000423762
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQRKSEGKVAGKTVLTSSSPSAMTLSYLD

SEQ ID NO: 69611 - protein, 1053 aa, Homo sapiens
  Payload ID: 13802
  Gene Symbol: PCDH11Y
  Gene Name: protocadherin 11 Y-linked
  Uniprot ID: Q9BZA8
  ENSP ID: ENSP00000215473
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPVGIQVSNTTF

SEQ ID NO: 69612 - protein, 1037 aa, Homo sapiens
  Payload ID: 13802
  Gene Symbol: PCDH11Y
  Gene Name: protocadherin 11 Y-linked
  Uniprot ID: Q9BZA8
  ENSP ID: ENSP00000330552
MTVGFNSDISSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPTDSRT

SEQ ID NO: 69613 - protein, 1048 aa, Homo sapiens
  Payload ID: 13802
  Gene Symbol: PCDH11Y
  Gene Name: protocadherin 11 Y-linked
  Uniprot ID: Q9BZA8
  ENSP ID: ENSP00000355419
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPTDSRT

SEQ ID NO: 69614 - protein, 1340 aa, Homo sapiens
  Payload ID: 13802
  Gene Symbol: PCDH11Y
  Gene Name: protocadherin 11 Y-linked
  Uniprot ID: Q9BZA8
  ENSP ID: ENSP00000383306
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKEITVQPTVEEASDNCTQECLIYGHSDACWMPASLDHSSSSQAQASALCHSPPLSQASTQHHSPPVTQTIVLCHSPPVTQTIALCHSPPPIQVSALHHSPPLVQGTALHHSPPSAQASALCYSPPLAQAAAISHSSSLPQVIALHRSQAQSSVSLQQGWVQGANGLCSVDQGVQGSATSQFYTMSERLHPSDDSIKVIPLTTFAPRQQARPSRGDSPIMETHPL

SEQ ID NO: 69615 - protein, 77 aa, Homo sapiens
  Payload ID: 13802
  Gene Symbol: PCDH11Y
  Gene Name: protocadherin 11 Y-linked
  ENSP ID: ENSP00000478548
MTVGFNSDISSVVRVNTTNCHKCLLSGTYIFAVLLVCVVFHSGAQEKNYTIREEIPENVLIGNLLKDLNLSLIPNKS

SEQ ID NO: 69616 - protein, 1037 aa, Homo sapiens; identical to SEQ ID NO: 69612
  Payload ID: 13802
  Gene Symbol: PCDH11Y
  Gene Name: protocadherin 11 Y-linked
  Uniprot ID: Q9BZA8
  ENSP ID: ENSP00000482115

SEQ ID NO: 69617 - protein, 1184 aa, Homo sapiens
  Payload ID: 13803
  Gene Symbol: PCDH12
  Gene Name: protocadherin 12
  Uniprot ID: Q9NPG4
  ENSP ID: ENSP00000231484
MMQLLQLLLGLLGPGGYLFLLGDCQEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGHNGLVHCWLSQELGHFRLKRTNGNTYMLLTNATLDREQWPKYTLTLLAQDQGLQPLSAKKQLSIQISDINDNAPVFEKSRYEVSTRENNLPSLHLITIKAHDADLGINGKVSYRIQDSPVAHLVAIDSNTGEVTAQRSLNYEEMAGFEFQVIAEDSGQPMLASSVSVWVSLLDANDNAPEVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLTVICLAVLLGIFGLILALFMSICRTEKKDNRAYNCREAESTYRQQPKRPQKHIQKADIHLVPVLRGQAGEPCEVGQSHKDVDKEAMMEAGWDPCLQAPFHLTPTLYRTLRNQGNQGAPAESREVLQDTVNLLFNHPRQRNASRENLNLPEPQPATGQPRSRPLKVAGSPTGRLAGDQGSEEAPQRPPASSATLRRQRHLNGKVSPEKESGPRQILRSLVRLSVAAFAERNPVEELTVDSPPVQQISQLLSLLHQGQFQPKPNHRGNKYLAKPGGSRSAIPDTDGPSARAGGQTDPEQEEGPLDPEEDLSVKQLLEEELSSLLDPSTGLALDRLSAPDPAWMARLSLPLTTNYRDNVISPDAAATEEPRTFQTFGKAEAPELSPTGTRLASTFVSEMSSLLEMLLEQRSSMPVEAASEALRRLSVCGRTLSLDLATSAASGMKVQGDPGGKTGTEGKSRGSSSSSRCL

SEQ ID NO: 69618 - protein, 23 aa, Homo sapiens
  Payload ID: 13803
  Gene Symbol: PCDH12
  Gene Name: protocadherin 12
  ENSP ID: ENSP00000429094
MMQLLQLLLGLLGPGGYLFLLGD

SEQ ID NO: 69619 - protein, 1159 aa, Homo sapiens
  Payload ID: 13804
  Gene Symbol: PCDH17
  Gene Name: protocadherin 17
  Uniprot ID: O14917
  ENSP ID: ENSP00000367151
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSSSTFKDPERASLRDSGHGDSDQADSDQDTNKGSCCDMSVREALKMKTTSTKSQPLEQEPEECVNCTDECRVLGHSDRCWMPQFPAANQAENADYRTNLFVPTVEANVETETYETVNPTGKKTFCTFGKDKREHTILIANVKPYLKAKRALSPLLQEVPSASSSPTKACIEPCTSTKGSLDGCEAKPGALAEASSQYLPTDSQYLSPSKQPRDPPFMASDQMARVFADVHSRASRDSSEMGAVLEQLDHPNRDLGRESVDAEEVVREIDKLLQDCRGNDPVAVRK

SEQ ID NO: 69620 - protein, 889 aa, Homo sapiens
  Payload ID: 13804
  Gene Symbol: PCDH17
  Gene Name: protocadherin 17
  Uniprot ID: O14917
  ENSP ID: ENSP00000432899
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSISVAPRLRTQKEPA

SEQ ID NO: 69621 - protein, 546 aa, Homo sapiens
  Payload ID: 13804
  Gene Symbol: PCDH17
  Gene Name: protocadherin 17
  ENSP ID: ENSP00000481329
LDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSSTFKDPERASLRDSGHGDSDQADSDQDTNKGSCCDMSVREALKMKTTSTKSQPLEQEPEECVNCTDECRVLGHSDRCWMPQFPAANQAENADYRTNLFVPTVEANVETETYETVNPTGKKTFCTFGKDKREHTILIANVKPYLKAKRALSPLLQEVPSASSSPTKACIEPCTSTKGSLDGCEAKPGALAEASSQYLPTDSQYLSPSKQPRDPPFMASDQMARVFADVHSRASRDSSEMGAVLEQLDHPNRDLGRESVDAEEVVREIDKLLQDCRGNDPVAVRK

SEQ ID NO: 69622 - protein, 184 aa, Homo sapiens
  Payload ID: 13804
  Gene Symbol: PCDH17
  Gene Name: protocadherin 17
  ENSP ID: ENSP00000483215
LTVPQGHAGCHTSFTGQGTNASETPATRMSIIQTDNFPAEPNYMGSRQQFVQSSSTFKDPERASLRDSGHGDSDQADSDQDTNKGSCCDMSVREALKMKTTSTKSQPLEQAFPTLLSFAILTLHTITSRLQSVDLLPPEPEECVNCTDECRVLGHSDRCWMPQFPAANQAENADYRTNLFVPTV

SEQ ID NO: 69623 - protein, 1135 aa, Homo sapiens
  Payload ID: 13805
  Gene Symbol: PCDH18
  Gene Name: protocadherin 18
  Uniprot ID: Q9HCL0
  ENSP ID: ENSP00000355082
MHQMNAKMHFRFVFALLIVSFNHDVLGKNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEQVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 69624 - protein, 1134 aa, Homo sapiens
  Payload ID: 13805
  Gene Symbol: PCDH18
  Gene Name: protocadherin 18
  Uniprot ID: Q9HCL0
  ENSP ID: ENSP00000390688
MHQMNAKMHFRFVFALLIVSFNHDVLGKNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 69625 - protein, 346 aa, Homo sapiens
  Payload ID: 13805
  Gene Symbol: PCDH18
  Gene Name: protocadherin 18
  ENSP ID: ENSP00000424269
MGSRQSHNSHQSLNSLVTISSNHVPENFSLELTHATPAVEQVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 69626 - protein, 315 aa, Homo sapiens
  Payload ID: 13805
  Gene Symbol: PCDH18
  Gene Name: protocadherin 18
  ENSP ID: ENSP00000425647
MPKVSGSRDTVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 69627 - protein, 914 aa, Homo sapiens
  Payload ID: 13805
  Gene Symbol: PCDH18
  Gene Name: protocadherin 18
  ENSP ID: ENSP00000425903
MGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 69628 - protein, 96 aa, Homo sapiens
  Payload ID: 13805
  Gene Symbol: PCDH18
  Gene Name: protocadherin 18
  ENSP ID: ENSP00000478176
MPKVSGSRDTVSQLLSMLHQGQYQPRPSFRGNKYSRSYRYALQDMDKFSLKDSGRGDSEAGDSDYDLGRDSPIDRLLGEGFSDLFLTDGRIPAVQL

SEQ ID NO: 69629 - protein, 1101 aa, Homo sapiens
  Payload ID: 13806
  Gene Symbol: PCDH19
  Gene Name: protocadherin 19
  Uniprot ID: Q8TAB3
  ENSP ID: ENSP00000255531
MESLLLPVLLLLAILWTQAAALINLKYSVEEEQRAGTVIANVAKDAREAGFALDPRQASAFRVVSNSAPHLVDINPSSGLLVTKQKIDRDLLCRQSPKCIISLEVMSSSMEICVIKVEIKDLNDNAPSFPAAQIELEISEAASPGTRIPLDSAYDPDSGSFGVQTYELTPNELFGLEIKTRGDGSRFAELVVEKSLDRETQSHYSFRITALDGGDPPRLGTVGLSIKVTDSNDNNPVFSESTYAVSVPENSPPNTPVIRLNASDPDEGTNGQVVYSFYGYVNDRTRELFQIDPHSGLVTVTGALDYEEGHVYELDVQAKDLGPNSIPAHCKVTVSVLDTNDNPPVINLLSVNSELVEVSESAPPGYVIALVRVSDRDSGLNGRVQCRLLGNVPFRLQEYESFSTILVDGRLDREQHDQYNLTIQARDGGVPMLQSAKSFTVLITDENDNHPHFSKPYYQVIVQENNTPGAYLLSVSARDPDLGLNGSVSYQIVPSQVRDMPVFTYVSINPNSGDIYALRSFNHEQTKAFEFKVLAKDGGLPSLQSNATVRVIILDVNDNTPVITAPPLINGTAEVYIPRNSGIGYLVTVVKAEDYDEGENGRVTYDMTEGDRGFFEIDQVNGEVRTTRTFGESSKSSYELIVVAHDHGKTSLSASALVLIYLSPALDAQESMGSVNLSLIFIIALGSIAGILFVTMIFVAIKCKRDNKEIRTYNCRIAEYSYGHQKKSSKKKKISKNDIRLVPRDVEETDKMNVVSCSSLTSSLNYFDYHQQTLPLGCRRSESTFLNVENQNTRNTSANHIYHHSFNSQGPQQPDLIINGVPLPETENYSFDSNYVNSRAHLIKSSSTFKDLEGNSLKDSGHEESDQTDSEHDVQRSLYCDTAVNDVLNTSVTSMGSQMPDHDQNEGFHCREECRILGHSDRCWMPRNPMPIRSKSPEHVRNIIALSIEATAADVEAYDDCGPTKRTFATFGKDVSDHPAEERPTLKGKRTVDVTICSPKVNSVIREAGNGCEAISPVTSPLHLKSSLPTKPSVSYTIALAPPARDLEQYVNNVNNGPTRPSEAEPRGADSEKVMHEVSPILKEGRNKESPGVKRLKDIVL

SEQ ID NO: 69630 - protein, 1148 aa, Homo sapiens
  Payload ID: 13806
  Gene Symbol: PCDH19
  Gene Name: protocadherin 19
  Uniprot ID: Q8TAB3
  ENSP ID: ENSP00000362125
MESLLLPVLLLLAILWTQAAALINLKYSVEEEQRAGTVIANVAKDAREAGFALDPRQASAFRVVSNSAPHLVDINPSSGLLVTKQKIDRDLLCRQSPKCIISLEVMSSSMEICVIKVEIKDLNDNAPSFPAAQIELEISEAASPGTRIPLDSAYDPDSGSFGVQTYELTPNELFGLEIKTRGDGSRFAELVVEKSLDRETQSHYSFRITALDGGDPPRLGTVGLSIKVTDSNDNNPVFSESTYAVSVPENSPPNTPVIRLNASDPDEGTNGQVVYSFYGYVNDRTRELFQIDPHSGLVTVTGALDYEEGHVYELDVQAKDLGPNSIPAHCKVTVSVLDTNDNPPVINLLSVNSELVEVSESAPPGYVIALVRVSDRDSGLNGRVQCRLLGNVPFRLQEYESFSTILVDGRLDREQHDQYNLTIQARDGGVPMLQSAKSFTVLITDENDNHPHFSKPYYQVIVQENNTPGAYLLSVSARDPDLGLNGSVSYQIVPSQVRDMPVFTYVSINPNSGDIYALRSFNHEQTKAFEFKVLAKDGGLPSLQSNATVRVIILDVNDNTPVITAPPLINGTAEVYIPRNSGIGYLVTVVKAEDYDEGENGRVTYDMTEGDRGFFEIDQVNGEVRTTRTFGESSKSSYELIVVAHDHGKTSLSASALVLIYLSPALDAQESMGSVNLSLIFIIALGSIAGILFVTMIFVAIKCKRDNKEIRTYNCSNCLTITCLLGCFIKGQNSKCLHCISVSPISEEQDKKTEEKVSLRGKRIAEYSYGHQKKSSKKKKISKNDIRLVPRDVEETDKMNVVSCSSLTSSLNYFDYHQQTLPLGCRRSESTFLNVENQNTRNTSANHIYHHSFNSQGPQQPDLIINGVPLPETENYSFDSNYVNSRAHLIKSSSTFKDLEGNSLKDSGHEESDQTDSEHDVQRSLYCDTAVNDVLNTSVTSMGSQMPDHDQNEGFHCREECRILGHSDRCWMPRNPMPIRSKSPEHVRNIIALSIEATAADVEAYDDCGPTKRTFATFGKDVSDHPAEERPTLKGKRTVDVTICSPKVNSVIREAGNGCEAISPVTSPLHLKSSLPTKPSVSYTIALAPPARDLEQYVNNVNNGPTRPSEAEPRGADSEKVMHEVSPILKEGRNKESPGVKRLKDIVL

SEQ ID NO: 69631 - protein, 1100 aa, Homo sapiens
  Payload ID: 13806
  Gene Symbol: PCDH19
  Gene Name: protocadherin 19
  Uniprot ID: Q8TAB3
  ENSP ID: ENSP00000400327
MESLLLPVLLLLAILWTQAAALINLKYSVEEEQRAGTVIANVAKDAREAGFALDPRQASAFRVVSNSAPHLVDINPSSGLLVTKQKIDRDLLCRQSPKCIISLEVMSSSMEICVIKVEIKDLNDNAPSFPAAQIELEISEAASPGTRIPLDSAYDPDSGSFGVQTYELTPNELFGLEIKTRGDGSRFAELVVEKSLDRETQSHYSFRITALDGGDPPRLGTVGLSIKVTDSNDNNPVFSESTYAVSVPENSPPNTPVIRLNASDPDEGTNGQVVYSFYGYVNDRTRELFQIDPHSGLVTVTGALDYEEGHVYELDVQAKDLGPNSIPAHCKVTVSVLDTNDNPPVINLLSVNSELVEVSESAPPGYVIALVRVSDRDSGLNGRVQCRLLGNVPFRLQEYESFSTILVDGRLDREQHDQYNLTIQARDGGVPMLQSAKSFTVLITDENDNHPHFSKPYYQVIVQENNTPGAYLLSVSARDPDLGLNGSVSYQIVPSQVRDMPVFTYVSINPNSGDIYALRSFNHEQTKAFEFKVLAKDGGLPSLQSNATVRVIILDVNDNTPVITAPPLINGTAEVYIPRNSGIGYLVTVVKAEDYDEGENGRVTYDMTEGDRGFFEIDQVNGEVRTTRTFGESSKSSYELIVVAHDHGKTSLSASALVLIYLSPALDAQESMGSVNLSLIFIIALGSIAGILFVTMIFVAIKCKRDNKEIRTYNCRIAEYSYGHQKKSSKKKKISKNDIRLVPRDVEETDKMNVVSCSSLTSSLNYFDYHQQTLPLGCRRSESTFLNVENQNTRNTSANHIYHHSFNSQGPQQPDLIINGVPLPETENYSFDSNYVNSRAHLIKSSTFKDLEGNSLKDSGHEESDQTDSEHDVQRSLYCDTAVNDVLNTSVTSMGSQMPDHDQNEGFHCREECRILGHSDRCWMPRNPMPIRSKSPEHVRNIIALSIEATAADVEAYDDCGPTKRTFATFGKDVSDHPAEERPTLKGKRTVDVTICSPKVNSVIREAGNGCEAISPVTSPLHLKSSLPTKPSVSYTIALAPPARDLEQYVNNVNNGPTRPSEAEPRGADSEKVMHEVSPILKEGRNKESPGVKRLKDIVL

SEQ ID NO: 69632 - protein, 7 aa, Homo sapiens
  Payload ID: 13806
  Gene Symbol: PCDH19
  Gene Name: protocadherin 19
  ENSP ID: ENSP00000479805
RLKDIVL

SEQ ID NO: 69633 - protein, 951 aa, Homo sapiens
  Payload ID: 13807
  Gene Symbol: PCDH20
  Gene Name: protocadherin 20
  Uniprot ID: Q8N6Y1
  ENSP ID: ENSP00000387250
MRGRGNARSSQALGVSWCPATWHPRLDMGRLHRPRSSTSYRNLPHLFLFFLFVGPFSCLGSYSRATELLYSLNEGLPAGVLIGSLAEDLRLLPRSAGRPDPQSQLPERTGAEWNPPLSFSLASRGLSGQYVTLDNRSGELHTSAQEIDREALCVEGGGGTAWSGSVSISSSPSDSCLLLLDVLVLPQEYFRFVKVKIAIRDINDNAPQFPVSQISVWVPENAPVNTRLAIEHPAVDPDVGINGVQTYRLLDYHGMFTLDVEENENGERTPYLIVMGALDRETQDQYVSIIIAEDGGSPPLLGSATLTIGISDINDNCPLFTDSQINVTVYGNATVGTPIAAVQAVDKDLGTNAQITYSYSQKVPQASKDLFHLDENTGVIKLFSKIGGSVLESHKLTILANGPGCIPAVITALVSIIKVIFRPPEIVPRYIANEIDGVVYLKELEPVNTPIAFFTIRDPEGKYKVNCYLDGEGPFRLSPYKPYNNEYLLETTKPMDYELQQFYEVAVVAWNSEGFHVKRVIKVQLLDDNDNAPIFLQPLIELTIEENNSPNAFLTKLYATDADSEERGQVSYFLGPDAPSYFSLDSVTGILTVSTQLDREEKEKYRYTVRAVDCGKPPRESVATVALTVLDKNDNSPRFINKDFSFFVPENFPGYGEIGVISVTDADAGRNGWVALSVVNQSDIFVIDTGKGMLRAKVSLDREQQSSYTLWVEAVDGGEPALSSTAKITILLLDINDNPPLVLFPQSNMSYLLVLPSTLPGSPVTEVYAVDKDTGMNAVIAYSIIGRRGPRPESFRIDPKTGNITLEEALLQTDYGLHRLLVKVSDHGYPEPLHSTVMVNLFVNDTVSNESYIESLLRKEPEINIEEKEPQISIEPTHRKVESVSCMPTLVALSVISLGSITLVTGMGIYICLRKGEKHPREDENLEVQIPLKGKIDLHMRERKPMDISNI

SEQ ID NO: 69634 - protein, 1069 aa, Homo sapiens
  Payload ID: 13808
  Gene Symbol: PCDH7
  Gene Name: protocadherin 7
  Uniprot ID: O60245
  ENSP ID: ENSP00000355243
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQMRLHPYITVFG

SEQ ID NO: 69635 - protein, 937 aa, Homo sapiens
  Payload ID: 13808
  Gene Symbol: PCDH7
  Gene Name: protocadherin 7
  ENSP ID: ENSP00000427066
  MOD_RES (1)..(1): Any amino acid
XVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQPFRRVTFSVVSQPQDPHQGSLQSCYDSGLEESETPSSKSSSGPRLGALPLPEDNYERTTPDGSVDSRPLPDVALTGKCTRECDEYGHSDSCWMPVRTSPERKKSQPKLSTFMPVDERGSQEKLANGEAAIMGDRNRNLLNKKLTSSYETFSAASFSKNEEANPEDIPLTKTGEYKPSPVNTLTRREVYL

SEQ ID NO: 69636 - protein, 1072 aa, Homo sapiens
  Payload ID: 13808
  Gene Symbol: PCDH7
  Gene Name: protocadherin 7
  Uniprot ID: O60245
  ENSP ID: ENSP00000441802
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQVRCIPNIFKYPREG

SEQ ID NO: 69637 - protein, 125 aa, Homo sapiens
  Payload ID: 13808
  Gene Symbol: PCDH7
  Gene Name: protocadherin 7
  ENSP ID: ENSP00000483285
  MOD_RES (1)..(1): Any amino acid
XNISIGSDHCSEYSCQTNNKYSKQPFRRVTFSVVSQPQDPHQGSLQSCYDSGLEESETPSSKSSSGPRLGALPLPEDNYERTTPDGSVGEAEHMENGVAAITTFPFLPFPHGKTHGRRVLLRPLH

SEQ ID NO: 69638 - protein, 584 aa, Homo sapiens
  Payload ID: 13808
  Gene Symbol: PCDH7
  Gene Name: protocadherin 7
  ENSP ID: ENSP00000484874
  MOD_RES (1)..(1): Any amino acid
XIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQLVMENNVLILDSFCQIAQKYHKPFRRVTFSVVSQPQDPHQGSLQSCYDSGLEESETPSSKSSSGPRLGALPLPEDNYERTTPDGSVDSRPLPDVALTGKCTRECDEYGHSDSCWMPVRTSPERKKSQPKLSTFMPVDERGSQEKLANGEAAIMGDRNRNLLNKKLTSSYETFSAASFSKNEEANPEDIPLTKTGEYKPSPVNTLTRREVYL

SEQ ID NO: 69639 - protein, 973 aa, Homo sapiens
  Payload ID: 13809
  Gene Symbol: PCDH8
  Gene Name: protocadherin 8
  Uniprot ID: O95206
  ENSP ID: ENSP00000341350
MSPVRRWGSPCLFPLQLFSLCWVLSVAQSKTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTPLIVIIVLAGSCTLLLAAIIAIATTCNRRKKEPYGASPGFGKEPAPPVAVWKGHSFNTISGREAEKFSGKDSGKGDSDFNDSDSDISGDALKKDLINHMQSGLWACTAECKILGHSDRCWSPSCSGPNAHPSPHPPAQMSTFCKSTSLPRDPLRRDNYYQAQLPKTVGLQSVYEKVLHRDYDRTVTLLSPPRPGRLPDLQEIGVPLYQSPPGRYLSPKKGANENV

SEQ ID NO: 69640 - protein, 1070 aa, Homo sapiens
  Payload ID: 13809
  Gene Symbol: PCDH8
  Gene Name: protocadherin 8
  Uniprot ID: O95206
  ENSP ID: ENSP00000367177
MSPVRRWGSPCLFPLQLFSLCWVLSVAQSKTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTPLIVIIVLAGSCTLLLAAIIAIATTCNRRKKEVRKGGALREERPGAAGGGASAPGSPEEAARGAGPRPNMFDVLTFPGTGKAPFGSPAADAPPPAVAAAEVPGSEGGSATGESACHFEGQQRLRGAHAEPYGASPGFGKEPAPPVAVWKGHSFNTISGREAEKFSGKDSGKGDSDFNDSDSDISGDALKKDLINHMQSGLWACTAECKILGHSDRCWSPSCSGPNAHPSPHPPAQMSTFCKSTSLPRDPLRRDNYYQAQLPKTVGLQSVYEKVLHRDYDRTVTLLSPPRPGRLPDLQEIGVPLYQSPPGRYLSPKKGANENV

SEQ ID NO: 69641 - protein, 1032 aa, Homo sapiens
  Payload ID: 13810
  Gene Symbol: PCDH9
  Gene Name: protocadherin 9
  ENSP ID: ENSP00000367092
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQVNEHFYWSISTAYKCPVNQY

SEQ ID NO: 69642 - protein, 1237 aa, Homo sapiens
  Payload ID: 13810
  Gene Symbol: PCDH9
  Gene Name: protocadherin 9
  Uniprot ID: Q9HC56
  ENSP ID: ENSP00000367096
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQCNSHSKSDNIPVTPQKCPSSTGFHIQENEESHYESQRRVTFHLPDGSQESCSDSGLGDHEPVGSGTLISHPLPLVQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 69643 - protein, 1195 aa, Homo sapiens
  Payload ID: 13810
  Gene Symbol: PCDH9
  Gene Name: protocadherin 9
  ENSP ID: ENSP00000401699
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQCNSHSKSDNIPVTPQKCPSSTGFHIQENEESHYEPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 69644 - protein, 1203 aa, Homo sapiens
  Payload ID: 13810
  Gene Symbol: PCDH9
  Gene Name: protocadherin 9
  Uniprot ID: Q9HC56
  ENSP ID: ENSP00000442186
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQSQRRVTFHLPDGSQESCSDSGLGDHEPVGSGTLISHPLPLVQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 69645 - protein, 44 aa, Homo sapiens
  Payload ID: 13810
  Gene Symbol: PCDH9
  Gene Name: protocadherin 9
  ENSP ID: ENSP00000482917
CNSHSKSDNIPVTPQKCPSSTGFHIQENEESHYEGTLPYLRYSL

SEQ ID NO: 69646 - protein, 807 aa, Homo sapiens
  Payload ID: 13811
  Gene Symbol: PCDHA1
  Gene Name: protocadherin alpha 1
  Uniprot ID: Q9Y5I3
  ENSP ID: ENSP00000367373
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNVSPTFEFWL

SEQ ID NO: 69647 - protein, 686 aa, Homo sapiens
  Payload ID: 13811
  Gene Symbol: PCDHA1
  Gene Name: protocadherin alpha 1
  Uniprot ID: Q9Y5I3
  ENSP ID: ENSP00000378129
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69648 - protein, 950 aa, Homo sapiens
  Payload ID: 13811
  Gene Symbol: PCDHA1
  Gene Name: protocadherin alpha 1
  Uniprot ID: Q9Y5I3
  ENSP ID: ENSP00000420840
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69649 - protein, 948 aa, Homo sapiens
  Payload ID: 13812
  Gene Symbol: PCDHA10
  Gene Name: protocadherin alpha 10
  Uniprot ID: Q9Y5I2
  ENSP ID: ENSP00000304234
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69650 - protein, 685 aa, Homo sapiens
  Payload ID: 13812
  Gene Symbol: PCDHA10
  Gene Name: protocadherin alpha 10
  Uniprot ID: Q9Y5I2
  ENSP ID: ENSP00000421030
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69651 - protein, 844 aa, Homo sapiens
  Payload ID: 13812
  Gene Symbol: PCDHA10
  Gene Name: protocadherin alpha 10
  Uniprot ID: Q9Y5I2
  ENSP ID: ENSP00000478748
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKVGYYVFIFLLCFMNNIFSYRIFSNMYQNISFLSTFHLCLNISSDTFVI

SEQ ID NO: 69652 - protein, 949 aa, Homo sapiens
  Payload ID: 13813
  Gene Symbol: PCDHA11
  Gene Name: protocadherin alpha 11
  Uniprot ID: Q9Y5I1
  ENSP ID: ENSP00000381636
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69653 - protein, 199 aa, Homo sapiens
  Payload ID: 13813
  Gene Symbol: PCDHA11
  Gene Name: protocadherin alpha 11
  ENSP ID: ENSP00000482347
  MOD_RES (1)..(1): Any amino acid
XVSSLLVLTLLLYTALWWSATPTEGACAPGKPTLVCSRAVGSWSYSQQRRQRVCSEEGPPKTDLMAFSPSLPLGLNKEEEGERQEPGSNHPGQPRQPNPDWRYSASLRAGMHSSVHLEEAGILRAGPGGPDQQWPTVSSATPEPEAGEVSPPVGAGVNSNSWTFKYGPGNPKQSGPEPKKQTQVSFLLRRKGEASQPRQ

SEQ ID NO: 69654 - protein, 810 aa, Homo sapiens
  Payload ID: 13813
  Gene Symbol: PCDHA11
  Gene Name: protocadherin alpha 11
  Uniprot ID: Q9Y5I1
  ENSP ID: ENSP00000482503
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQVSFLQIPPIRKCM

SEQ ID NO: 69655 - protein, 941 aa, Homo sapiens
  Payload ID: 13814
  Gene Symbol: PCDHA12
  Gene Name: protocadherin alpha 12
  Uniprot ID: Q9UN75
  ENSP ID: ENSP00000381628
MVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69656 - protein, 792 aa, Homo sapiens
  Payload ID: 13814
  Gene Symbol: PCDHA12
  Gene Name: protocadherin alpha 12
  Uniprot ID: Q9UN75
  ENSP ID: ENSP00000481404
MVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEVSY

SEQ ID NO: 69657 - protein, 950 aa, Homo sapiens
  Payload ID: 13815
  Gene Symbol: PCDHA13
  Gene Name: protocadherin alpha 13
  Uniprot ID: Q9Y5I0
  ENSP ID: ENSP00000289272
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69658 - protein, 904 aa, Homo sapiens
  Payload ID: 13815
  Gene Symbol: PCDHA13
  Gene Name: protocadherin alpha 13
  ENSP ID: ENSP00000386821
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEPRQPNPDWRYSASLRAGMHSSVHLEEAGILRAGPGGPDQQWPTVSSATPEPEAGEVSPPVGAGVNSNSWTFKYGPGNPKQSGPEPKKQTQVSFLLRRKGEASQPRQ

SEQ ID NO: 69659 - protein, 807 aa, Homo sapiens
  Payload ID: 13815
  Gene Symbol: PCDHA13
  Gene Name: protocadherin alpha 13
  Uniprot ID: Q9Y5I0
  ENSP ID: ENSP00000479167
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEVSLYFKKLS

SEQ ID NO: 69660 - protein, 824 aa, Homo sapiens
  Payload ID: 13816
  Gene Symbol: PCDHA2
  Gene Name: protocadherin alpha 2
  Uniprot ID: Q9Y5H9
  ENSP ID: ENSP00000367372
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKVSLLLFLANSKIVLFKKFYMISTSYLDS

SEQ ID NO: 69661 - protein, 808 aa, Homo sapiens
  Payload ID: 13816
  Gene Symbol: PCDHA2
  Gene Name: protocadherin alpha 2
  Uniprot ID: Q9Y5H9
  ENSP ID: ENSP00000430584
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKIWNFNLQIQLAS

SEQ ID NO: 69662 - protein, 948 aa, Homo sapiens
  Payload ID: 13816
  Gene Symbol: PCDHA2
  Gene Name: protocadherin alpha 2
  Uniprot ID: Q9Y5H9
  ENSP ID: ENSP00000431748
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69663 - protein, 950 aa, Homo sapiens
  Payload ID: 13817
  Gene Symbol: PCDHA3
  Gene Name: protocadherin alpha 3
  Uniprot ID: Q9Y5H8
  ENSP ID: ENSP00000429808
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69664 - protein, 824 aa, Homo sapiens
  Payload ID: 13817
  Gene Symbol: PCDHA3
  Gene Name: protocadherin alpha 3
  Uniprot ID: Q9Y5H8
  ENSP ID: ENSP00000434086
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKVSNFYLFFPKCLCFSFLNVSTPLEIH

SEQ ID NO: 69665 - protein, 776 aa, Homo sapiens
  Payload ID: 13818
  Gene Symbol: PCDHA4
  Gene Name: protocadherin alpha 4
  ENSP ID: ENSP00000367365
VVYSRVGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLP

SEQ ID NO: 69666 - protein, 901 aa, Homo sapiens
  Payload ID: 13818
  Gene Symbol: PCDHA4
  Gene Name: protocadherin alpha 4
  ENSP ID: ENSP00000423470
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPEPKKQTQVSFLLRRKGEASQPRQ

SEQ ID NO: 69667 - protein, 947 aa, Homo sapiens
  Payload ID: 13818
  Gene Symbol: PCDHA4
  Gene Name: protocadherin alpha 4
  Uniprot ID: Q9UN74
  ENSP ID: ENSP00000435300
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69668 - protein, 798 aa, Homo sapiens
  Payload ID: 13818
  Gene Symbol: PCDHA4
  Gene Name: protocadherin alpha 4
  Uniprot ID: Q9UN74
  ENSP ID: ENSP00000481220
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKVSV

SEQ ID NO: 69669 - protein, 890 aa, Homo sapiens
  Payload ID: 13819
  Gene Symbol: PCDHA5
  Gene Name: protocadherin alpha 5
  Uniprot ID: Q9Y5H7
  ENSP ID: ENSP00000433416
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNPRQPNPDWRYSASLRAGMHSSVHLEEAGILRAGPGGPDQQWPTVSSATPEPEAGEVSPPVGAGVNSNSWTFKYGPGNPKQSGPEPKKQTQVSFLLRRKGEASQPRQ

SEQ ID NO: 69670 - protein, 936 aa, Homo sapiens
  Payload ID: 13819
  Gene Symbol: PCDHA5
  Gene Name: protocadherin alpha 5
  Uniprot ID: Q9Y5H7
  ENSP ID: ENSP00000436557
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69671 - protein, 816 aa, Homo sapiens
  Payload ID: 13819
  Gene Symbol: PCDHA5
  Gene Name: protocadherin alpha 5
  Uniprot ID: Q9Y5H7
  ENSP ID: ENSP00000484128
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNVSFLILTSIFPSQFSNIKCHIHPLFLYLKIMS

SEQ ID NO: 69672 - protein, 803 aa, Homo sapiens
  Payload ID: 13820
  Gene Symbol: PCDHA6
  Gene Name: protocadherin alpha 6
  Uniprot ID: Q9UN73
  ENSP ID: ENSP00000367366
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVNVYLIIAICAVSSLLVLTLLLYTALRCSAPPTEGACTADKPTLVCSSAVGSWSYSQQRRQRVCSGEGPPKMDLMAFSPSLSPCPIMMGKAENQDLNEDHDAKVSEFS

SEQ ID NO: 69673 - protein, 950 aa, Homo sapiens
  Payload ID: 13820
  Gene Symbol: PCDHA6
  Gene Name: protocadherin alpha 6
  Uniprot ID: Q9UN73
  ENSP ID: ENSP00000433378
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVNVYLIIAICAVSSLLVLTLLLYTALRCSAPPTEGACTADKPTLVCSSAVGSWSYSQQRRQRVCSGEGPPKMDLMAFSPSLSPCPIMMGKAENQDLNEDHDAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69674 - protein, 686 aa, Homo sapiens
  Payload ID: 13820
  Gene Symbol: PCDHA6
  Gene Name: protocadherin alpha 6
  Uniprot ID: Q9UN73
  ENSP ID: ENSP00000434113
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69675 - protein, 789 aa, Homo sapiens
  Payload ID: 13821
  Gene Symbol: PCDHA7
  Gene Name: protocadherin alpha 7
  Uniprot ID: Q9UN72
  ENSP ID: ENSP00000349344
MVCPNGYDPGGRHLLLFIIILAAWEAGRGQLHYSVPEEAKHGNFVGRIAQDLGLELAELVPRLFRAVCKFRGDLLEVNLQNGILFVNSRIDREELCGRSAECSIHLEVIVERPLQVFHVDVEVKDINDNPPVFPATQRNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTLTSLSLPIPEDAQPGTVITLISVFDRDFGVNGQVTCSLTPRVPFKLVSTFKNYYSLVLDSALDRESVSAYELVVTARDGGSPSLWATASVSVEVADVNDNAPAFAQPEYTVFVKENNPPGCHIFTVSAGDADAQKNALVSYSLVELRVGERALSSYVSVHAESGKVYALQPLDHEELELLQFQVSARDAGVPPLGSNVTLQVFVLDENDNAPALLAPRVGGTGGAVRELVPRSVGAGHVVAKVRAVDADSGYNAWLSYELQPVAAGASIPFRVGLYTGEISTTRALDETDAPRHRLLVLVKDHGEPSLTATATVLVSLVESGQAPKASSRASLGIAGPETELVDVNVYLIIAICAVSSLLVLTLLLYTALRCSAPSSEGACSLVKPTLVCSSAVGSWSFSQQRRQRVCSGEGPPKTDLMAFSPSLPQGPSSTDNVSHK

SEQ ID NO: 69676 - protein, 937 aa, Homo sapiens
  Payload ID: 13821
  Gene Symbol: PCDHA7
  Gene Name: protocadherin alpha 7
  Uniprot ID: Q9UN72
  ENSP ID: ENSP00000436426
MVCPNGYDPGGRHLLLFIIILAAWEAGRGQLHYSVPEEAKHGNFVGRIAQDLGLELAELVPRLFRAVCKFRGDLLEVNLQNGILFVNSRIDREELCGRSAECSIHLEVIVERPLQVFHVDVEVKDINDNPPVFPATQRNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTLTSLSLPIPEDAQPGTVITLISVFDRDFGVNGQVTCSLTPRVPFKLVSTFKNYYSLVLDSALDRESVSAYELVVTARDGGSPSLWATASVSVEVADVNDNAPAFAQPEYTVFVKENNPPGCHIFTVSAGDADAQKNALVSYSLVELRVGERALSSYVSVHAESGKVYALQPLDHEELELLQFQVSARDAGVPPLGSNVTLQVFVLDENDNAPALLAPRVGGTGGAVRELVPRSVGAGHVVAKVRAVDADSGYNAWLSYELQPVAAGASIPFRVGLYTGEISTTRALDETDAPRHRLLVLVKDHGEPSLTATATVLVSLVESGQAPKASSRASLGIAGPETELVDVNVYLIIAICAVSSLLVLTLLLYTALRCSAPSSEGACSLVKPTLVCSSAVGSWSFSQQRRQRVCSGEGPPKTDLMAFSPSLPQGPSSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69677 - protein, 814 aa, Homo sapiens
  Payload ID: 13822
  Gene Symbol: PCDHA8
  Gene Name: protocadherin alpha 8
  Uniprot ID: Q9Y5H6
  ENSP ID: ENSP00000367363
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKVSPFKFRTHKFYLWKL

SEQ ID NO: 69678 - protein, 950 aa, Homo sapiens
  Payload ID: 13822
  Gene Symbol: PCDHA8
  Gene Name: protocadherin alpha 8
  Uniprot ID: Q9Y5H6
  ENSP ID: ENSP00000434655
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69679 - protein, 842 aa, Homo sapiens
  Payload ID: 13823
  Gene Symbol: PCDHA9
  Gene Name: protocadherin alpha 9
  Uniprot ID: Q9Y5H5
  ENSP ID: ENSP00000367362
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTLLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVNVYLIIAICAVSSLLVLTLLLYTVLRCSAMPTEGECAPGKPTLVCSSAVGSWSYSQQRRQRVCSGEGKQKTDLMAFSPGLSPCAGSTERTGEPSASSDSTGKVGFSSILFIYIIFFLERYYRLLPGAVQIVLFIFLEIQQIFFLIK

SEQ ID NO: 69680 - protein, 950 aa, Homo sapiens
  Payload ID: 13823
  Gene Symbol: PCDHA9
  Gene Name: protocadherin alpha 9
  Uniprot ID: Q9Y5H5
  ENSP ID: ENSP00000436042
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTLLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVNVYLIIAICAVSSLLVLTLLLYTVLRCSAMPTEGECAPGKPTLVCSSAVGSWSYSQQRRQRVCSGEGKQKTDLMAFSPGLSPCAGSTERTGEPSASSDSTGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69681 - protein, 963 aa, Homo sapiens
  Payload ID: 13824
  Gene Symbol: PCDHAC1
  Gene Name: protocadherin alpha subfamily C, 1
  Uniprot ID: Q9H158
  ENSP ID: ENSP00000253807
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69682 - protein, 818 aa, Homo sapiens
  Payload ID: 13824
  Gene Symbol: PCDHAC1
  Gene Name: protocadherin alpha subfamily C, 1
  Uniprot ID: Q9H158
  ENSP ID: ENSP00000386356
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMVSKFYGI

SEQ ID NO: 69683 - protein, 1007 aa, Homo sapiens
  Payload ID: 13825
  Gene Symbol: PCDHAC2
  Gene Name: protocadherin alpha subfamily C, 2
  Uniprot ID: Q9Y5I4
  ENSP ID: ENSP00000289269
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 69684 - protein, 884 aa, Homo sapiens
  Payload ID: 13825
  Gene Symbol: PCDHAC2
  Gene Name: protocadherin alpha subfamily C, 2
  Uniprot ID: Q9Y5I4
  ENSP ID: ENSP00000478629
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEVRQWSGGLLQTHAFVTHPPISCDLALLSH

SEQ ID NO: 69685 - protein, 818 aa, Homo sapiens
  Payload ID: 13826
  Gene Symbol: PCDHB1
  Gene Name: protocadherin beta 1
  Uniprot ID: Q9Y5F3
  ENSP ID: ENSP00000307234
MAGTRRKSLQNRQVGSLLIFLCISVGDATTIRYSVAEEMESGSFVANVAKDLGLEVGKLAARGARLVSEGNKMHFRLHRKTGDLFVKEKLDRESLCGKADPCVLHFEVVLVEPLQSFRAEVRVFDINDNAPVFLNKEPLLKIPESTPLGSRFPLQSAQDLDVGLNGLQNYTLSANGYFHLHTRFCSHGPKYAELVLNKPLDREEQPEVNLTITAVDGGSPPKSGTAHIHVVVLDVNDHVPQFSRLVYRAQVSENSPNGSLVATVTAVDLDEGTNKAITYSLAQNPEAILKTFQIDPQNGEVRLRGPLDFEAIETYDIDIQATDGGGLSAHSKVLVEVVDVNDNPPEVMVSSVSSPLPEDSPPQTVVALFTIRDRDIRVGGKVTCFLREDLPFVIKPTFGNSYSLVTDRSLDREEVSGYNITIVAMDTGPPSLSAETMIEVLISDVNDNPPIFREDSYILTVRENNSPAVFIGKVHAEDLDLGENAQITYSLLPPKNGDLSVFAYISINSGNGKLYALRTMDYEAIQDFQFVVKATDGGFLSLSSQVTVRVVVLDDNDNRPMILYPLQNGTLPCNDLVPRSAEAGYLVTKVVAVDGDSGQNSWLSYHLLKATDLGLFSVQRQNGEIHTLRQISERDPMMQKLIILVQDHGQPALSTTVSLNILLVDGFSEPYLQFQDPTKHSRKVNPSTKYLVISLVILSFLFLLSVIVIFIIHVYQKIKYREKFTIQEHFYDDCNFSNNLVQGQGNGSLSRPCPYEMCSATGTGNSEFRFLKRFMPNFPFPHATGEIKMEAGSSLPPNSDRNKSQRLEGHDQVSDDYM

SEQ ID NO: 69686 - protein, 800 aa, Homo sapiens
  Payload ID: 13827
  Gene Symbol: PCDHB10
  Gene Name: protocadherin beta 10
  Uniprot ID: Q9UN67
  ENSP ID: ENSP00000239446
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNIQ

SEQ ID NO: 69687 - protein, 799 aa, Homo sapiens
  Payload ID: 13827
  Gene Symbol: PCDHB10
  Gene Name: protocadherin beta 10
  ENSP ID: ENSP00000444518
MEIGWMHNRRQRQVLVFFVLLSLSGAGAELGSYSVVEETERGSFVANLGKDLGLGLTEMSTRKARIISQGNKQHLQLKAQTGDLLINEKLDREELCGPTEPCILHFQVLMENPLEIFQAELRVIDINDHSPMFTEKEMILKIPENSPLGSLFLLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNI

SEQ ID NO: 69688 - protein, 797 aa, Homo sapiens
  Payload ID: 13828
  Gene Symbol: PCDHB11
  Gene Name: protocadherin beta 11
  Uniprot ID: Q9Y5F2
  ENSP ID: ENSP00000346802
MENQGTRTQQIRQVLLLFVLLGMSQAGSETWSFSVAEEMQSGSFVGNLAKDLGLKVRELSSRGARVVSNDKKQRLQLDINTGDLLLSETLDREELCGSIEPCVLHLQVLMQNPTQFLQIELQVRDINDHSPIFSEKQMLLEIPENSPVGAVFLLESAKDLDVGINAVKSYTISPNSHFHIKMRVIPDNRKYPELVLDKALDYEELPELSFILSALDGGSPPRSGTALVRVVVVDINDNSPEFEQAFYEVKIRENSILGSLILIVSAWDLDSGTNGEICYTFSHASEDIRKTFEINQKSGEITLRAPLDFETIESYSIIIQATDGGGLFGKSTVIIHVIDVNDNAPEITVSSITSPIPENTPETVVMVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYLVVALASVSSLFLFSVLLFVAVRLCRRSRAASVGSCSVPKGPFPGHLVDVSGTGTLSQSYQYEVCLTGGSETNEFKFLKPVIPNIQAKGLGKNSEENSTFRNSFGFNF

SEQ ID NO: 69689 - protein, 432 aa, Homo sapiens
  Payload ID: 13828
  Gene Symbol: PCDHB11
  Gene Name: protocadherin beta 11
  Uniprot ID: Q9Y5F2
  ENSP ID: ENSP00000485553
MVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYLVVALASVSSLFLFSVLLFVAVRLCRRSRAASVGSCSVPKGPFPGHLVDVSGTGTLSQSYQYEVCLTGGSETNEFKFLKPVIPNIQAKGLGKNSEENSTFRNSFGFNF

SEQ ID NO: 69690 - protein, 795 aa, Homo sapiens
  Payload ID: 13829
  Gene Symbol: PCDHB12
  Gene Name: protocadherin beta 12
  Uniprot ID: Q9Y5F1
  ENSP ID: ENSP00000239450
MENGGAGTLQIRQVLLFFVLLGMSQAGSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 69691 - protein, 458 aa, Homo sapiens
  Payload ID: 13829
  Gene Symbol: PCDHB12
  Gene Name: protocadherin beta 12
  Uniprot ID: Q9Y5F1
  ENSP ID: ENSP00000485303
MDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 69692 - protein, 67 aa, Homo sapiens
  Payload ID: 13829
  Gene Symbol: PCDHB12
  Gene Name: protocadherin beta 12
  ENSP ID: ENSP00000485352
MENGGAGTLQIRQVLLFFVLLGMSQAGSETGNFLVMEELQSGSFVGNLAKTLGLEHLWILKQLSHTQ

SEQ ID NO: 69693 - protein, 798 aa, Homo sapiens
  Payload ID: 13830
  Gene Symbol: PCDHB13
  Gene Name: protocadherin beta 13
  Uniprot ID: Q9Y5F0
  ENSP ID: ENSP00000345491
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 69694 - protein, 798 aa, Homo sapiens
  Payload ID: 13831
  Gene Symbol: PCDHB14
  Gene Name: protocadherin beta 14
  Uniprot ID: Q9Y5E9
  ENSP ID: ENSP00000239449
MEIRGALDLRKRQVLIFLVLLGLSRAGTESAHYSVAEETEIGSFVANLARDLGLGVEELSSREARVVSDDNKKYLHLDLLTGNLLLNEKLDRDELCGSTEPCVLHFQVVLENPLQFFRFELCVKDINDHSPTFLDKEILIKISEGTTVGATFLMESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGGSGTNEFKFLKPIIPNFQVHDTGRNMGEIENFRNSFGLNIQ

SEQ ID NO: 69695 - protein, 645 aa, Homo sapiens
  Payload ID: 13831
  Gene Symbol: PCDHB14
  Gene Name: protocadherin beta 14
  Uniprot ID: Q9Y5E9
  ENSP ID: ENSP00000485055
MESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGGSGTNEFKFLKPIIPNFQVHDTGRNMGEIENFRNSFGLNIQ

SEQ ID NO: 69696 - protein, 787 aa, Homo sapiens
  Payload ID: 13832
  Gene Symbol: PCDHB15
  Gene Name: protocadherin beta 15
  Uniprot ID: Q9Y5E8
  ENSP ID: ENSP00000231173
MEPAGERFPEQRQVLILLLLLEVTLAGWEPRRYSVMEETERGSFVANLANDLGLGVGELAERGARVVSEDNEQGLQLDLQTGQLILNEKLDREKLCGPTEPCIMHFQVLLKKPLEVFRAELLVTDINDHSPEFPEREMTLKIPETSSLGTVFPLKKARDLDVGSNNVQNYNISPNSHFHVSTRTRGDGRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKKLDFETMSSYDLDIEASDGGGLSGKCSVSVKVLDVNDNFPELSISSLTSPIPENSPETEVALFRIRDRDSGENGKMICSIQDDVPFKLKPSVENFYRLVTEGALDRETRAEYNITITITDLGTPRLKTEQSITVLVSDVNDNAPAFTQTSYTLFVRENNSPALHIGSVSATDRDSGTNAQVTYSLLPPRDPHLPLTSLVSINTDNGHLFALQSLDYEALQAFEFRVGATDRGFPALSSEALVRVLVLDANDNSPFVLYPLQNGSAPCTELVPRAAEPGYLVTKVVAVDGDSGQNAWLSYQLLKATEPGLFGVWAHNGEVRTARLLSERDVAKHRLVVLVKDNGEPPRSATATLQVLLVDGFSQPYLPLPEAAPAQAQADSLTVYLVVALASVSSLFLFSVFLFVAVRLCRRSRAASVGRCSVPEGPFPGHLVDVSGTGTLSQSYQYEVCLTGGSESNDFKFLKPIFPNIVSQDSRRKSEFLE

SEQ ID NO: 69697 - protein, 129 aa, Homo sapiens
  Payload ID: 13832
  Gene Symbol: PCDHB15
  Gene Name: protocadherin beta 15
  ENSP ID: ENSP00000485504
MEPAGERFPEQRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKK

SEQ ID NO: 69698 - protein, 776 aa, Homo sapiens
  Payload ID: 13833
  Gene Symbol: PCDHB16
  Gene Name: protocadherin beta 16
  Uniprot ID: Q9NRJ7
  ENSP ID: ENSP00000477314
MEIGWMHNRRQRQVLVFFVLLSLSGAGAELGSYSVVEETERGSFVANLGKDLGLGLTEMSTRKARIISQGNKQHLQLKAQTGDLLINEKLDREELCGPTEPCILHFQVLMENPLEIFQAELRVIDINDHSPMFTEKEMILKIPENSPLGTEFPLNHALDLDVGSNNVQNYKISPSSHFRVLIHEFRDGRKYPELVLDKELDREEEPQLRLTLTALDGGSPPRSGTAQVRIEVVDINDNAPEFEQPIYKVQIPENSPLGSLVATVSARDLDGGANGKISYTLFQPSEDISKTLEVNPMTGEVRLRKQVDFEMVTSYEVRIKATDGGGLSGKCTLLLQVVDVNDNPPQVTMSALTSPIPENSPEIVVAVFSVSDPDSGNNGKTISSIQEDLPFLLKPSVKNFYTLVTERALDREARAEYNITLTVTDMGTPRLKTEHNITVQISDVNDNAPTFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPRSATATLHVLLVDGFSQPFLPLPEAAPGQTQANSLTVYLVVALASVSSLFLFSVLLFVAVRLCRRSRAASVGRCSMPEGPFPGRLVDVSGTGTLSQSYQYEVCLTGGSETSEFKFLKPIIPNFSP

SEQ ID NO: 69699 - protein, 222 aa, Homo sapiens
  Payload ID: 13833
  Gene Symbol: PCDHB16
  Gene Name: protocadherin beta 16
  ENSP ID: ENSP00000485449
MSALTSPIPENSPEIVVAVFSVSDPDSGNNGKTISSIQEDLPFLLKPSVKNFYTLVTERALDREARAEYNITLTVTDMGTPRLKTEHNITVQISDVNDNAPTFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSA

SEQ ID NO: 69700 - protein, 798 aa, Homo sapiens
  Payload ID: 13834
  Gene Symbol: PCDHB2
  Gene Name: protocadherin beta 2
  Uniprot ID: Q9Y5E7
  ENSP ID: ENSP00000194155
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFT

SEQ ID NO: 69701 - protein, 39 aa, Homo sapiens
  Payload ID: 13834
  Gene Symbol: PCDHB2
  Gene Name: protocadherin beta 2
  ENSP ID: ENSP00000485040
MEAGEGKERVPKQRTCPGLGCRNQQSPKLHNQSQFPLSS

SEQ ID NO: 69702 - protein, 50 aa, Homo sapiens
  Payload ID: 13834
  Gene Symbol: PCDHB2
  Gene Name: protocadherin beta 2
  ENSP ID: ENSP00000485270
MEAGEGKERVPKQRKYHSWNYFLNRTCPGLGCRNQQSPKLHNQSQFPLSS

SEQ ID NO: 69703 - protein, 36 aa, Homo sapiens
  Payload ID: 13834
  Gene Symbol: PCDHB2
  Gene Name: protocadherin beta 2
  ENSP ID: ENSP00000485376
MEAGEGKERVPKQRQSRWHNITTAGAEQSPGSRGAA

SEQ ID NO: 69704 - protein, 54 aa, Homo sapiens
  Payload ID: 13834
  Gene Symbol: PCDHB2
  Gene Name: protocadherin beta 2
  ENSP ID: ENSP00000485480
QAQADLLTVYLMVDVSGTGTLSQSYQYEVCLTGGSGTNEFKFLKPIIPNFVAQG

SEQ ID NO: 69705 - protein, 796 aa, Homo sapiens
  Payload ID: 13835
  Gene Symbol: PCDHB3
  Gene Name: protocadherin beta 3
  Uniprot ID: Q9Y5E6
  ENSP ID: ENSP00000231130
MEAGGERFLRQRQVLLLFVFLGGSLAGSESRRYSVAEEKEKGFLIANLAKDLGLRVEELAARGAQVVSKGNKQHFQLSHQTGDLLLNEKLDREELCGPTEPCILHFQILLQNPLQFVTNELRIIDVNDHSPVFFENEMHLKILESTLPGTVIPLGNAEDLDVGRNSLQNYTITPNSHFHVLTRSRRDGRKYPELVLDKALDPEEQPELSLTLTALDGGSPPRSGTAQINIQVLDINDNAPEFAQPLYEVAVLENTPVNSVIVTVSASDLDTGSFGTISYAFFHASEEIRKTFQLNPITGDMQLVKYLNFEAINSYEVDIEAKDGGGLSGKSTVIVQVVDVNDNPPELTLSSVNSPIPENSGETVLAVFSVSDLDSGDNGRVMCSIENNLPFFLKPSVENFYTLVSEGALDRETRSEYNITITITDLGTPRLKTKYNITVLVSDVNDNAPAFTQISYTLFVRENNSPALHIGSVSATDRDSGTNAQVTYSLLPPQDPHLPLSSLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFS

SEQ ID NO: 69706 - protein, 54 aa, Homo sapiens; identical to SEQ ID NO: 69704
  Payload ID: 13835
  Gene Symbol: PCDHB3
  Gene Name: protocadherin beta 3
  ENSP ID: ENSP00000485531

SEQ ID NO: 69707 - protein, 795 aa, Homo sapiens
  Payload ID: 13836
  Gene Symbol: PCDHB4
  Gene Name: protocadherin beta 4
  Uniprot ID: Q9Y5E5
  ENSP ID: ENSP00000194152
MKKLGRIHPNRQVLAFILMVFLSQVRLEPIRYSVLEETESGSFVAHLAKDLGLGIGELASRSARVLSDDDKQRLQLDRQTGDLLLREKLDREELCGPIEPCVLHFQVFLEMPVQFFQGELLIQDINDHSPIFPEREVLLKILENSQPGTLFPLLIAEDLDVGSNGLQKYTISPNSHFHILTRNHSEGKKYPDLVQDKPLDREEQPEFSLTLVALDGGSPPRSGTVMVRILIMDINDNAPEFVHTPYGVQVLENSPLDSPIVRVLARDIDAGNFGSVSYGLFQASDEIKQTFSINEVTGEILLKKKLDFEKIKSYHVEIEATDGGGLSGKGTVVIEVVDVNDNPPELIISSLTSSIPENAPETVVSIFRIRDRDSGENGKMICSIPDNLPFILKPTLKNFYTLVTERPLDRETSAEYNITIAVTDLGTPRLKTQQNITVQVSDVNDNAPAFTQTSYTLFVRENNSPALHIGSVSATDRDSGTNAQVTYSLLPPQDPHLPLASLVSINADNGHLFALRSLDYEALQAFEFRVGASDRGSPALSSEALVRVLVLDTNDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGDSGTGEFKFLKPIFPNLLVQDTGREVKENPKFRNSLVFS

SEQ ID NO: 69708 - protein, 795 aa, Homo sapiens
  Payload ID: 13837
  Gene Symbol: PCDHB5
  Gene Name: protocadherin beta 5
  Uniprot ID: Q9Y5E4
  ENSP ID: ENSP00000231134
METALAKTPQKRQVMFLAILLLLWEAGSEAVRYSIPEETESGYSVANLAKDLGLGVGELATRGARMHYKGNKELLQLDIKTGNLLLYEKLDREVMCGATEPCILHFQLLLENPVQFFQTDLQLTDINDHAPEFPEKEMLLKIPESTQPGTVFPLKIAQDFDIGSNTVQNYTISPNSHFHVATHNRGDGRKYPELVLDKALDREERPELSLTLTALDGGAPPRSGTTTIRIVVLDNNDNAPEFLQSFYEVQVPENSPLNSLVVVVSARDLDAGAYGSVAYALFQGDEVTQPFVIDEKTAEIRLKRALDFEATPYYNVEIVATDGGGLSGKCTVAIEVVDVNDNAPELTMSTLSSPTPENAPETVVAVFSVSDPDSGDNGRMICSIQNDLPFLLKPTLKNFYTLVTQRTLDRESQAEYNITITVTDMGTPRLKTEHNITVLVSDVNDNAPAFTQTSYTLFVRENNSPALHIGSVSATDRDSGTNAQVTYSLLPPQNPHLRLASLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFSMWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCLTGDSGAGEFKFLKPIIPNLLPQGAGEEIGKTAAFRNSFGLN

SEQ ID NO: 69709 - protein, 247 aa, Homo sapiens
  Payload ID: 13837
  Gene Symbol: PCDHB5
  Gene Name: protocadherin beta 5
  ENSP ID: ENSP00000485464
MGTPRLKTEHNITVLVSDVNDNAPAFTQTSYTLFVRENNSPALHIGSVSATDRDSGTNAQVTYSLLPPQNPHLRLASLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFSMWAHNGEVRTARLLSERDAAKHRLVVLVKDNGEPPRSATATLHVLLVDGFSQPYLP

SEQ ID NO: 69710 - protein, 794 aa, Homo sapiens
  Payload ID: 13838
  Gene Symbol: PCDHB6
  Gene Name: protocadherin beta 6
  Uniprot ID: Q9Y5E3
  ENSP ID: ENSP00000231136
MMQTKVQNKKRQVAFFILLMLWGEVGSESIQYSVLEETESGTFVANLTKDLGLRVGELASRGARVVFKGNRQHLQFDPQTHDLLLNEKLDREELCGSTEPCVLPFQVLLENPLQFFQASLRVRDINDHAPEFPAREMLLKISEITMPGKIFPLKMAHDLDTGSNGLQRYTISSNPHFHVLTRNRSEGRKFPELVLDKPLDREEQPQLRLTLIALDGGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNAPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRYSVPEGPFPGHLVDVSGTGTLSQSYQYKVCLTGGSETNEFKFLKPIMPNFPPQGTEREMEETPTSRNSFPFS

SEQ ID NO: 69711 - protein, 658 aa, Homo sapiens
  Payload ID: 13838
  Gene Symbol: PCDHB6
  Gene Name: protocadherin beta 6
  ENSP ID: ENSP00000485034
MLLKISEITMPGKIFPLKMAHDLDTGSNGLQRYTISSNPHFHVLTRNRSEGRKFPELVLDKPLDREEQPQLRLTLIALDGGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNAPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRYSVPEGPFPGHLVDVSGTGTLSQSYQYKVCLTGGSETNEFKFLKPIMPNFPPQGTEREMEETPTSRNSFPFS

SEQ ID NO: 69712 - protein, 793 aa, Homo sapiens
  Payload ID: 13839
  Gene Symbol: PCDHB7
  Gene Name: protocadherin beta 7
  Uniprot ID: Q9Y5E2
  ENSP ID: ENSP00000231137
MEARVERAVQKRQVLFLCVFLGMSWAGAEPLRYFVAEETERGTFLTNLAKDLGLGVGELRARGTRIVSDQNMQILLLSSLTGDLLLNEKLDREELCGPREPCVLPFQLLLEKPFQIFRAELWVRDINDHAPVFLDREISLKILESTTPGAAFLLESAQDSDVGTNSLSNYTISPNAYFHINVHDSGEGNIYPELVLNQVLDREEIPEFSLTLTALDGGSPPRSGTALVRILVLDVNDNAPDFVRSLYKVQVPENSPVGSMVVSVSARDLDTGSNGEIAYAFSYATERILKTFQINPTSGSLHLKAQLDYEAIQTYTLTIQAKDGGGLSGKCTVVVDVTDINDNRPELLLSSLTSPIAENSPETVVAVFRIRDRDSGNNGKTVCSIQDDVPFILKPSVENFYTLVTEKPLDRERNTEYNITITVTDLGTPRLKTEHNITVLVSDVNDNAPAFTQTSYTLFVRENNSPALPIGSVSATDRDSGTNAQVIYSLLPSQDPHLPLASLVSINADNGHLFALRSLDYEALQAFEFRVGATDRGSPALSSEALVRVLVLDANDNSPFVLYPLQNSSAPCTEPLPRAAEPGYLVTKVVAVDGDSGQNAWLSYQLLKATEPGLFGVWAHNGEVRTARLLSERDAAKQRLVVLVKDNGEPPRSATATLHVLLVDGFSQPYLRLPEAAPDQANSLTVYLVVALASVSSLFLLSVLLFVAVRLCRRSRAAPVGRCSVPEGPFPRHLVDLSGTGTLSQSYQYEVCLTGGSGTNEFKFLKPIIPNLLPQSTGREVEENRPFQNNLGF

SEQ ID NO: 69713 - protein, 801 aa, Homo sapiens
  Payload ID: 13840
  Gene Symbol: PCDHB8
  Gene Name: protocadherin beta 8
  Uniprot ID: Q9UN66
  ENSP ID: ENSP00000239444
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTAFPLKNAEDLDIGQNNIENYIISPNSYFRVLTRKRSDGRKYPELVLDKALDREEEAELRLTLTALDGGSPPRSGTAQVYIEVVDVNDNAPEFEQPFYRVQISEDSPISFLVVKVSATDVDTGVNGEISYSLFQASDEISKTFKVDFLTGEIRLKKQLDFEKFQSYEVNIEARDAGGFSGKCTVLIQVIDVNDHAPEVTMSAFTSPIPENAPETVVALFSVSDLDSGENGKISCSIQEDLPFLLKSSVGNFYTLLTETPLDRESRAEYNVTITVTDLGTPRLTTHLNMTVLVSDVNDNAPAFTQTSYTLFVRENNSPALHIGSVSATDRDSGTNAQVTYSLLPPQDPHLPLASLVSINTDNGHLFALRSLDYEALQAFEFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPCSATATLHVLLVDGFSQPYLPLPEAAPAQGQADSLTVYLVVALASVSSLFLFSVLLFVAVLLCRRSRAASVGRCSVPEGPFPGHLVDVRGTGSLSQNYQYEVCLAGGSGTNEFQLLKPVLPNIQGHSFGPEMEQNSNFRNGFGFSLQLK

SEQ ID NO: 69714 - protein, 797 aa, Homo sapiens
  Payload ID: 13841
  Gene Symbol: PCDHB9
  Gene Name: protocadherin beta 9
  Uniprot ID: Q9Y5E1
  ENSP ID: ENSP00000478606
MKTRGFSFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHSPVFRHKEMVLKISENTAEGTAFRLERAQDPDEGHNSIQNYTISSNSFFHIKISGSDEGMIYPELVLDKALDREEQEELSLTLTALDGGSPSRSGTSTIRIVVLDVNDNVPQFAQALYETQAPENSPVGSLIVKVSAGDADSGVNAEVSYSFFDASEDILTTFQINPFSGEIFLRELLDYELVNSYKINIQAMDGGGLSARCTVLIKVLDSNDNPPELIISSLSNSVAENSPGIVLAVFKIKDRDSGENGKTICYVQDNLPFFLKPSVDNFYILMTEGALDRESKAEYNITITVTDLGTPRLKTEHSITLQVSDVNDNAPAFTQTSYTLFVRENNSPALHIGSVSATDRDSGTNAQVTYSLLPPQDPHLPLASLVSINADNGHLFALRSLDYEALQAFDFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLLSVLLFVAVRLCRRSRAASVGRCSVPEGPFPGHLVDVSGTGTLFQSYQYEVCLTGGSETGEFKFLKPITPHLPPHRGGKEIEENSTLPNSFGFNY

SEQ ID NO: 69715 - protein, 73 aa, Homo sapiens
  Payload ID: 13841
  Gene Symbol: PCDHB9
  Gene Name: protocadherin beta 9
  ENSP ID: ENSP00000485394
MTEGALDRESKAEYNITITVTDLGTPRLKTEHSITLQVSDVNDNAPAFTQTSYTLFVRENNSPALHIGSVSAT

SEQ ID NO: 69716 - protein, 823 aa, Homo sapiens
  Payload ID: 13842
  Gene Symbol: PCDHGA1
  Gene Name: protocadherin gamma subfamily A, 1
  Uniprot ID: Q9Y5H4
  ENSP ID: ENSP00000367345
MKIQKKLTGCSRLMLLCLSLELLLEAGAGNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLYLVVAAAAVSCVFLAFVIVLLAHRLRRWHKSRLLQASGGGLASMPGSHFVGVDGVRAFLQTYSHEVSLTADSRKSHLIFPQPNYADTLISQESCEKKGFLSAPQSLLEDKKEPFSQVNFCDECISYLEKNNS

SEQ ID NO: 69717 - protein, 931 aa, Homo sapiens
  Payload ID: 13842
  Gene Symbol: PCDHGA1
  Gene Name: protocadherin gamma subfamily A, 1
  Uniprot ID: Q9Y5H4
  ENSP ID: ENSP00000431083
MKIQKKLTGCSRLMLLCLSLELLLEAGAGNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLYLVVAAAAVSCVFLAFVIVLLAHRLRRWHKSRLLQASGGGLASMPGSHFVGVDGVRAFLQTYSHEVSLTADSRKSHLIFPQPNYADTLISQESCEKKGFLSAPQSLLEDKKEPFSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69718 - protein, 936 aa, Homo sapiens
  Payload ID: 13843
  Gene Symbol: PCDHGA10
  Gene Name: protocadherin gamma subfamily A, 10
  Uniprot ID: Q9Y5H3
  ENSP ID: ENSP00000381611
MAAQRNRSKESKDCSGLVLLCLFFGIPWEAGARQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLYLVVAVAAVSCVFLAFVIVLLAHRLRRWHKSRLLQASGGGLTGVSGSHFVGVDGVRAFLQTYSHEVSLTADSRKSHLIFPQPNYADTLISQESCEKNDPLSLLDDSKFPIEDTPLVPQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69719 - protein, 850 aa, Homo sapiens
  Payload ID: 13843
  Gene Symbol: PCDHGA10
  Gene Name: protocadherin gamma subfamily A, 10
  Uniprot ID: Q9Y5H3
  ENSP ID: ENSP00000481157
MAAQRNRSKESKDCSGLVLLCLFFGIPWEAGARQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLYLVVAVAAVSCVFLAFVIVLLAHRLRRWHKSRLLQASGGGLTGVSGSHFVGVDGVRAFLQTYSHEVSLTADSRKSHLIFPQPNYADTLISQESCEKNDPLSLLDDSKFPIEDTPLVPVSFIFIFTFVKKKKIGFYFEVCGMMVESVNAKTLMSRI

SEQ ID NO: 69720 - protein, 935 aa, Homo sapiens
  Payload ID: 13844
  Gene Symbol: PCDHGA11
  Gene Name: protocadherin gamma subfamily A, 11
  Uniprot ID: Q9Y5H2
  ENSP ID: ENSP00000381589
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLYLVVAVAAVSCIFLVFVIVLLALRLWRWHKSRLLQASEGGLAGMPTSHFVGVDGVQAFLQTYSHEVSLIADSQKSHLIFPQPNYGDTLISQESCEKSEPLLIAEDSAIILGKCDPTSNQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69721 - protein, 750 aa, Homo sapiens
  Payload ID: 13844
  Gene Symbol: PCDHGA11
  Gene Name: protocadherin gamma subfamily A, 11
  Uniprot ID: Q9Y5H2
  ENSP ID: ENSP00000428333
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69722 - protein, 837 aa, Homo sapiens
  Payload ID: 13844
  Gene Symbol: PCDHGA11
  Gene Name: protocadherin gamma subfamily A, 11
  Uniprot ID: Q9Y5H2
  ENSP ID: ENSP00000480917
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLYLVVAVAAVSCIFLVFVIVLLALRLWRWHKSRLLQASEGGLAGMPTSHFVGVDGVQAFLQTYSHEVSLIADSQKSHLIFPQPNYGDTLISQESCEKSEPLLIAEDSAIILGKCDPTSNQVRFISLPPNCWCLGTSLLRRCFLSLL

SEQ ID NO: 69723 - protein, 932 aa, Homo sapiens
  Payload ID: 13845
  Gene Symbol: PCDHGA12
  Gene Name: protocadherin gamma subfamily A, 12
  Uniprot ID: O60330
  ENSP ID: ENSP00000252085
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69724 - protein, 820 aa, Homo sapiens
  Payload ID: 13845
  Gene Symbol: PCDHGA12
  Gene Name: protocadherin gamma subfamily A, 12
  Uniprot ID: O60330
  ENSP ID: ENSP00000481438
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEVSLYQIFFLFFF

SEQ ID NO: 69725 - protein, 932 aa, Homo sapiens
  Payload ID: 13846
  Gene Symbol: PCDHGA2
  Gene Name: protocadherin gamma subfamily A, 2
  Uniprot ID: Q9Y5H1
  ENSP ID: ENSP00000378077
MAALQKLPHCRKLVLLCFLLATLWEARAGQIRYSVREEIDRGSFVGNIAKDLGLEPLALAEQGVRIVSRGRSQLFALNPRSGSLVTANRIDREELCAQSAPCLLNFNILLEDKLTIYSVEVEITDINDNAPRFGVEELELKISETTTPGFRIPLKNAHDADVGENALQKYALNPNDHFSLDVRRGADGNKYPELVLERSLDREEEAVHHLVLVASDGGDPVLSGTSRICVKVLDANDNAPVFTQPEYRISIPENTLVGTRILTVTATDADEGYYAQVVYFLEKSPGETSEVFELKSTSGELTIIKDLDYEDATFHEIDIEAQDGPGLLTRAKVIVTVLDVNDNAPEFYMTSATSSVSEDSLPGTIIGLFNVHDRDSGQNAFTTCSLPEDLPFKLEKSVDNYYRLVTTRALDREQFSFYNITLTAKDGGNPSLSTDAHILLQVADINDNAPAFSRTSYSTYIPENNPRGASVFSVTAHDPDSNDNAHVTYSFAEDTVQGAPLSSYISINSDTGVLYALRSFDYEQLRDLQVWVIARDSGNPPLSSNVSLSLFVLDQNDNAPEILYPAFPTDGSTGVELAPRSAEPGYLVTKVVAVDRDSGQNAWLSYHLLKASEPGLFSVGLHTGEVRTARALLDRDALKQSLVVAIQDHGQPPLSATVTLTVAVADRIPDILADLGSLEPSAIPNDSDLTLYLVVAVAAVSCVFLAFVIVLLAHRLRRWHKSRLLQASGGSLTGMQSSHFVGVDGVRAFLQTYSHEVSLTADSRKSHLIFPQPNYADTLISQESCEKKDFLSAPQSLLEEEREETFSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69726 - protein, 823 aa, Homo sapiens
  Payload ID: 13846
  Gene Symbol: PCDHGA2
  Gene Name: protocadherin gamma subfamily A, 2
  Uniprot ID: Q9Y5H1
  ENSP ID: ENSP00000483020
MAALQKLPHCRKLVLLCFLLATLWEARAGQIRYSVREEIDRGSFVGNIAKDLGLEPLALAEQGVRIVSRGRSQLFALNPRSGSLVTANRIDREELCAQSAPCLLNFNILLEDKLTIYSVEVEITDINDNAPRFGVEELELKISETTTPGFRIPLKNAHDADVGENALQKYALNPNDHFSLDVRRGADGNKYPELVLERSLDREEEAVHHLVLVASDGGDPVLSGTSRICVKVLDANDNAPVFTQPEYRISIPENTLVGTRILTVTATDADEGYYAQVVYFLEKSPGETSEVFELKSTSGELTIIKDLDYEDATFHEIDIEAQDGPGLLTRAKVIVTVLDVNDNAPEFYMTSATSSVSEDSLPGTIIGLFNVHDRDSGQNAFTTCSLPEDLPFKLEKSVDNYYRLVTTRALDREQFSFYNITLTAKDGGNPSLSTDAHILLQVADINDNAPAFSRTSYSTYIPENNPRGASVFSVTAHDPDSNDNAHVTYSFAEDTVQGAPLSSYISINSDTGVLYALRSFDYEQLRDLQVWVIARDSGNPPLSSNVSLSLFVLDQNDNAPEILYPAFPTDGSTGVELAPRSAEPGYLVTKVVAVDRDSGQNAWLSYHLLKASEPGLFSVGLHTGEVRTARALLDRDALKQSLVVAIQDHGQPPLSATVTLTVAVADRIPDILADLGSLEPSAIPNDSDLTLYLVVAVAAVSCVFLAFVIVLLAHRLRRWHKSRLLQASGGSLTGMQSSHFVGVDGVRAFLQTYSHEVSLTADSRKSHLIFPQPNYADTLISQESCEKKDFLSAPQSLLEEEREETFSQVIYLFTTYVLASLLK

SEQ ID NO: 69727 - protein, 932 aa, Homo sapiens
  Payload ID: 13847
  Gene Symbol: PCDHGA3
  Gene Name: protocadherin gamma subfamily A, 3
  Uniprot ID: Q9Y5H0
  ENSP ID: ENSP00000253812
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLRRWHKSRLLQASGGGLASTPGSHFVGADGVRAFLQTYSHEVSLTADSRKSHLIFPQPNYADTLISQESCEKSEPLLITQDLLEMKGDSNLLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69728 - protein, 829 aa, Homo sapiens
  Payload ID: 13847
  Gene Symbol: PCDHGA3
  Gene Name: protocadherin gamma subfamily A, 3
  Uniprot ID: Q9Y5H0
  ENSP ID: ENSP00000479265
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLRRWHKSRLLQASGGGLASTPGSHFVGADGVRAFLQTYSHEVSLTADSRKSHLIFPQPNYADTLISQESCEKSEPLLITQDLLEMKGDSNLLQVSLFISLIIKNKYENVVIIKL

SEQ ID NO: 69729 - protein, 107 aa, Homo sapiens
  Payload ID: 13847
  Gene Symbol: PCDHGA3
  Gene Name: protocadherin gamma subfamily A, 3
  ENSP ID: ENSP00000481801
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLRNWK

SEQ ID NO: 69730 - protein, 962 aa, Homo sapiens
  Payload ID: 13848
  Gene Symbol: PCDHGA4
  Gene Name: protocadherin gamma subfamily A, 4
  ENSP ID: ENSP00000458570
MHFILDPEDPGAPQASTEGKPKHRRLRGGVVMAAPPARPDHTRLLQICLLLGVLVEIRAEQILYSVFEEQEEGSVVGNIAKDLGLAPRELAERGVRIVSRGRTQLFALNPRSGTLVTAGRIDREELCDRSPNCVTNLEILLEDTVKILRVEVEIIDVNDNPPSFGTEQREIKVAENENPGARFPLPEAFDPDVGVNSLQGYQLNSNGYFSLDVQSGADGIKYPELVLERALDREEEAVHHLVLTAFDGGDPVRSGTARILIILVDTNDNAPVFTQPEYHVSVRENVPVGTRLLTVKATDPDEGANGDVTYSFRKVRDKISQLFQLNSLSGDITILGGLDYEDSGFYDIDVEAHDGPGLRARSKVLVTVLDENDNAPEVTVTSLTSSVQESSSPGTVIALFNVHDSDSGGNGLVTCSIPDNLPFTLEKTYGNYYRLLTHRTLDREEVSEYNITVTATDQGTPPLSTETHISLQVMDINDNPPTFPHASYSAYIPENNPRGASILSMTAQDPDSGDNARITYSLAEDTFQGAPLSSYVSINSNTGILYALCSFDYEQFRDLQLLMTASDSGDPPLSSNVSLSLFVLDQNDNVPEILYPTFPTDGSTGVELAPRSADSGYLVTKVVAVDRDSGQNAWLSYSLLKSSEPGLFAVGLHTGEVRTARALLDRDALKQRLVVVVQDHGQPPLSATVTLTVAVADSIPDVLADLGSLKPSADPDDSGLTLYLVVAVAAVSCVFLAFVTVLLALKLRRWHKSRLLHAEGSRLAGVPASHFVGVDGVRAFLQTYSHEVSLTADSRKSHLIFSQPSYADTLISRESCEKSEPLLITQDLLETKGDPNLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69731 - protein, 851 aa, Homo sapiens
  Payload ID: 13848
  Gene Symbol: PCDHGA4
  Gene Name: protocadherin gamma subfamily A, 4
  ENSP ID: ENSP00000477894
MHFILDPEDPGAPQASTEGKPKHRRLRGGVVMAAPPARPDHTRLLQICLLLGVLVEIRAEQILYSVFEEQEEGSVVGNIAKDLGLAPRELAERGVRIVSRGRTQLFALNPRSGTLVTAGRIDREELCDRSPNCVTNLEILLEDTVKILRVEVEIIDVNDNPPSFGTEQREIKVAENENPGARFPLPEAFDPDVGVNSLQGYQLNSNGYFSLDVQSGADGIKYPELVLERALDREEEAVHHLVLTAFDGGDPVRSGTARILIILVDTNDNAPVFTQPEYHVSVRENVPVGTRLLTVKATDPDEGANGDVTYSFRKVRDKISQLFQLNSLSGDITILGGLDYEDSGFYDIDVEAHDGPGLRARSKVLVTVLDENDNAPEVTVTSLTSSVQESSSPGTVIALFNVHDSDSGGNGLVTCSIPDNLPFTLEKTYGNYYRLLTHRTLDREEVSEYNITVTATDQGTPPLSTETHISLQVMDINDNPPTFPHASYSAYIPENNPRGASILSMTAQDPDSGDNARITYSLAEDTFQGAPLSSYVSINSNTGILYALCSFDYEQFRDLQLLMTASDSGDPPLSSNVSLSLFVLDQNDNVPEILYPTFPTDGSTGVELAPRSADSGYLVTKVVAVDRDSGQNAWLSYSLLKSSEPGLFAVGLHTGEVRTARALLDRDALKQRLVVVVQDHGQPPLSATVTLTVAVADSIPDVLADLGSLKPSADPDDSGLTLYLVVAVAAVSCVFLAFVTVLLALKLRRWHKSRLLHAEGSRLAGVPASHFVGVDGVRAFLQTYSHEVSLTADSRKSHLIFSQPSYADTLISRESCEKSEPLLITQDLLETKGDPNLQVSQSYNRSYHTEI

SEQ ID NO: 69732 - protein, 931 aa, Homo sapiens
  Payload ID: 13849
  Gene Symbol: PCDHGA5
  Gene Name: protocadherin gamma subfamily A, 5
  Uniprot ID: Q9Y5G8
  ENSP ID: ENSP00000429834
MASPPRGWGCGELLLPFMLLGTLCEPGSGQIRYSMPEELDKGSFVGNIAKDLGLEPQELAERGVRIVSRGRTQLFALNPRSGSLVTAGRIDREELCAQSPLCVVNFNILVENKMKIYGVEVEIIDINDNFPRFRDEELKVKVNENAAAGTRLVLPFARDADVGVNSLRSYQLSSNLHFSLDVVSGTDGQKYPELVLEQPLDREKETVHDLLLTALDGGDPVLSGTTHIRVTVLDANDNAPLFTPSEYSVSVPENIPVGTRLLMLTATDPDEGINGKLTYSFRNEEEKISETFQLDSNLGEISTLQSLDYEESRFYLMEVVAQDGGALVASAKVVVTVQDVNDNAPEVILTSLTSSISEDCLPGTVIALFSVHDGDSGENGEIACSIPRNLPFKLEKSVDNYYHLLTTRDLDREETSDYNITLTVMDHGTPPLSTESHIPLKVADVNDNPPNFPQASYSTSVTENNPRGVSIFSVTAHDPDSGDNARVTYSLAEDTFQGAPLSSYVSINSDTGVLYALRSFDYEQLRDLQLWVTASDSGNPPLSSNVSLSLFVLDQNDNTPEILYPALPTDGSTGVELAPRSAEPGYLVTKVVAVDKDSGQNAWLSYRLLKASEPGLFAVGLHTGEVRTARALLDRDALKQSLVVAVEDHGQPPLSATFTVTVAVADRIPDILADLGSIKTPIDPEDLDLTLYLVVAVAAVSCVFLAFVIVLLVLRLRRWHKSRLLQAEGSRLAGVPASHFVGVDGVRAFLQTYSHEVSLTADSRKSHLIFPQPNYADTLLSEESCEKSEPLLMSDKVDANKEERRVQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69733 - protein, 813 aa, Homo sapiens
  Payload ID: 13849
  Gene Symbol: PCDHGA5
  Gene Name: protocadherin gamma subfamily A, 5
  Uniprot ID: Q9Y5G8
  ENSP ID: ENSP00000480337
MASPPRGWGCGELLLPFMLLGTLCEPGSGQIRYSMPEELDKGSFVGNIAKDLGLEPQELAERGVRIVSRGRTQLFALNPRSGSLVTAGRIDREELCAQSPLCVVNFNILVENKMKIYGVEVEIIDINDNFPRFRDEELKVKVNENAAAGTRLVLPFARDADVGVNSLRSYQLSSNLHFSLDVVSGTDGQKYPELVLEQPLDREKETVHDLLLTALDGGDPVLSGTTHIRVTVLDANDNAPLFTPSEYSVSVPENIPVGTRLLMLTATDPDEGINGKLTYSFRNEEEKISETFQLDSNLGEISTLQSLDYEESRFYLMEVVAQDGGALVASAKVVVTVQDVNDNAPEVILTSLTSSISEDCLPGTVIALFSVHDGDSGENGEIACSIPRNLPFKLEKSVDNYYHLLTTRDLDREETSDYNITLTVMDHGTPPLSTESHIPLKVADVNDNPPNFPQASYSTSVTENNPRGVSIFSVTAHDPDSGDNARVTYSLAEDTFQGAPLSSYVSINSDTGVLYALRSFDYEQLRDLQLWVTASDSGNPPLSSNVSLSLFVLDQNDNTPEILYPALPTDGSTGVELAPRSAEPGYLVTKVVAVDKDSGQNAWLSYRLLKASEPGLFAVGLHTGEVRTARALLDRDALKQSLVVAVEDHGQPPLSATFTVTVAVADRIPDILADLGSIKTPIDPEDLDLTLYLVVAVAAVSCVFLAFVIVLLVLRLRRWHKSRLLQAEGSRLAGVPASHFVGVDGVRAFLQTYSHEVSLTADSRKSHLIFPQPNYADTLLSEESCEKSEPLLMSDKVDANKEERRVQVSFLFR

SEQ ID NO: 69734 - protein, 932 aa, Homo sapiens
  Payload ID: 13850
  Gene Symbol: PCDHGA6
  Gene Name: protocadherin gamma subfamily A, 6
  Uniprot ID: Q9Y5G7
  ENSP ID: ENSP00000429601
MAPPQRHPQRSEQVLLLTLLGTLWGAAAAQIRYSIPEELEKGSFVGNIVKDLGLEPQELAEHGVRIVSRGRMQLFSLNPRNGSLVTAGRIDREELCAQSPRCLVSFNILVEDKLNLYPVEVEIVDINDNTPRFLKEELEVKILENAAPSSRFPLMEVYDPDVGMNSLQGFKLSGNSHFSVDVQSEAHGPKYPELVLEGTLDREGEAVYRLVLTAMDGGDPVRSSVAQILVTVLDVNDNTPMFTQPVYRVSVPENLPVGTPVLAVTATDQDEGVHGEVTYSFVKITEKISQIFCLNVLTGEISTSANLDYEDSSFYELGVEARDGPGLRDRAKVLITILDVNDNVPEVVVTSGSRTIAESAPPGTVIALFQVFDRDSGLNGLVTCSIPRSLPFELEKSVGNYYRLVTNAALDREEVFLYNITVTATDKGTPPLSTETIISLNVADTNDNPPTFPHSSYSVYVLENNPRGASIFSVNALDPDVDQNAQVSYSLAEDTLQGAPLSSYVSINSDTGILYALRSFDYEQLRDLQLWVTASDSGDPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLQRWHKSRLLQASGGGLASMPGSHFVGVEGVRAFLQTYSHEVSLTADSRKSHLIFPQPNYADTLINQESYEKSEPLLITQDLLETKGEPRQLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69735 - protein, 818 aa, Homo sapiens
  Payload ID: 13850
  Gene Symbol: PCDHGA6
  Gene Name: protocadherin gamma subfamily A, 6
  Uniprot ID: Q9Y5G7
  ENSP ID: ENSP00000479478
MAPPQRHPQRSEQVLLLTLLGTLWGAAAAQIRYSIPEELEKGSFVGNIVKDLGLEPQELAEHGVRIVSRGRMQLFSLNPRNGSLVTAGRIDREELCAQSPRCLVSFNILVEDKLNLYPVEVEIVDINDNTPRFLKEELEVKILENAAPSSRFPLMEVYDPDVGMNSLQGFKLSGNSHFSVDVQSEAHGPKYPELVLEGTLDREGEAVYRLVLTAMDGGDPVRSSVAQILVTVLDVNDNTPMFTQPVYRVSVPENLPVGTPVLAVTATDQDEGVHGEVTYSFVKITEKISQIFCLNVLTGEISTSANLDYEDSSFYELGVEARDGPGLRDRAKVLITILDVNDNVPEVVVTSGSRTIAESAPPGTVIALFQVFDRDSGLNGLVTCSIPRSLPFELEKSVGNYYRLVTNAALDREEVFLYNITVTATDKGTPPLSTETIISLNVADTNDNPPTFPHSSYSVYVLENNPRGASIFSVNALDPDVDQNAQVSYSLAEDTLQGAPLSSYVSINSDTGILYALRSFDYEQLRDLQLWVTASDSGDPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLQRWHKSRLLQASGGGLASMPGSHFVGVEGVRAFLQTYSHEVSLTADSRKSHLIFPQPNYADTLINQESYEKSEPLLITQDLLETKGEPRQLQVSFFPPKREE

SEQ ID NO: 69736 - protein, 932 aa, Homo sapiens
  Payload ID: 13851
  Gene Symbol: PCDHGA7
  Gene Name: protocadherin gamma subfamily A, 7
  Uniprot ID: Q9Y5G6
  ENSP ID: ENSP00000430024
MAAQPRGGDYRGFFLLSILLGTPWEAWAGRILYSVSEETDKGSFVGDIAKDLGLEPRELAERGVRIISRGRTQLFALNQRSGSLVTAGRIDREEICAQSARCLVNFNILMEDKMNLYPIDVEIIDINDNVPRFLTEEINVKIMENTAPGVRFPLSEAGDPDVGTNSLQSYQLSPNRHFSLAVQSGDDETKYPELVLERVLDREEERVHHLVLTASDGGDPPRSSTAHIQVTVVDVNDHTPVFSLPQYQVTVPENVPVGTRLLTVHAIDLDEGVNGEVTYSFRKITPKLPKMFHLNSLTGEISTLEGLDYEETAFYEMEVQAQDGPGSLTKAKVLITVLDVNDNAPEVTMTSLSSSIPEDTPLGTVIALFYLQDRDSGKNGEVTCTIPENLPFKLEKSIDNYYRLVTTKNLDRETLSLYNITLKATDGGTPPLSRETHIFMQVADTNDNPPTFPHSSYSVYIAENNPRGASIFLVTAQDHDSEDNAQITYSLAEDTIQGAPVSSYVSINSDTGVLYALQSFDYEQLRELQLRVTAHDSGDPPLSSNMSLSLFVLDQNDNPPEILYPALPTDGSTGMELAPRSAEPGYLVTKVVAVDKDSGQNAWLSYLLLKASEPGLFAVGLYTGEVRTARALLDRDALKQSLVVAVQDHGQPPLSATVTLTVAVADSIPEVLADLGSLEPSDGPYNYDLTLYLVVAVATVSCVFLAFVLVLLALRLRRWHKSRLLQASEGGLANVPTSHFVGMDGVQAFLQTYSHEVSLTADSRKSHLIFPQPNYVDMLISQESCEKNDSLLTSVDFQECKENLPSIQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69737 - protein, 817 aa, Homo sapiens
  Payload ID: 13851
  Gene Symbol: PCDHGA7
  Gene Name: protocadherin gamma subfamily A, 7
  Uniprot ID: Q9Y5G6
  ENSP ID: ENSP00000477805
MAAQPRGGDYRGFFLLSILLGTPWEAWAGRILYSVSEETDKGSFVGDIAKDLGLEPRELAERGVRIISRGRTQLFALNQRSGSLVTAGRIDREEICAQSARCLVNFNILMEDKMNLYPIDVEIIDINDNVPRFLTEEINVKIMENTAPGVRFPLSEAGDPDVGTNSLQSYQLSPNRHFSLAVQSGDDETKYPELVLERVLDREEERVHHLVLTASDGGDPPRSSTAHIQVTVVDVNDHTPVFSLPQYQVTVPENVPVGTRLLTVHAIDLDEGVNGEVTYSFRKITPKLPKMFHLNSLTGEISTLEGLDYEETAFYEMEVQAQDGPGSLTKAKVLITVLDVNDNAPEVTMTSLSSSIPEDTPLGTVIALFYLQDRDSGKNGEVTCTIPENLPFKLEKSIDNYYRLVTTKNLDRETLSLYNITLKATDGGTPPLSRETHIFMQVADTNDNPPTFPHSSYSVYIAENNPRGASIFLVTAQDHDSEDNAQITYSLAEDTIQGAPVSSYVSINSDTGVLYALQSFDYEQLRELQLRVTAHDSGDPPLSSNMSLSLFVLDQNDNPPEILYPALPTDGSTGMELAPRSAEPGYLVTKVVAVDKDSGQNAWLSYLLLKASEPGLFAVGLYTGEVRTARALLDRDALKQSLVVAVQDHGQPPLSATVTLTVAVADSIPEVLADLGSLEPSDGPYNYDLTLYLVVAVATVSCVFLAFVLVLLALRLRRWHKSRLLQASEGGLANVPTSHFVGMDGVQAFLQTYSHEVSLTADSRKSHLIFPQPNYVDMLISQESCEKNDSLLTSVDFQECKENLPSIQVSPALPLFP

SEQ ID NO: 69738 - protein, 932 aa, Homo sapiens
  Payload ID: 13852
  Gene Symbol: PCDHGA8
  Gene Name: protocadherin gamma subfamily A, 8
  Uniprot ID: Q9Y5G5
  ENSP ID: ENSP00000381605
MAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLYLVVAVAAISCVFLAFVAVLLGLRLRRWHKSRLLQDSGGRLVGVPASHFVGVEEVQAFLQTYSQEVSLTADSRKSHLIFPQPNYADMLISQEGCEKNDSLLTSVDFHEYKNEADHGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69739 - protein, 820 aa, Homo sapiens
  Payload ID: 13852
  Gene Symbol: PCDHGA8
  Gene Name: protocadherin gamma subfamily A, 8
  Uniprot ID: Q9Y5G5
  ENSP ID: ENSP00000483161
MAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLYLVVAVAAISCVFLAFVAVLLGLRLRRWHKSRLLQDSGGRLVGVPASHFVGVEEVQAFLQTYSQEVSLTADSRKSHLIFPQPNYADMLISQEGCEKNDSLLTSVDFHEYKNEADHGQVSLVLCLLLISR

SEQ ID NO: 69740 - protein, 932 aa, Homo sapiens
  Payload ID: 13853
  Gene Symbol: PCDHGA9
  Gene Name: protocadherin gamma subfamily A, 9
  Uniprot ID: Q9Y5G4
  ENSP ID: ENSP00000460274
MAAPTKCQLRGRLVLLCSLLGMLWEARASQIRYSVPEETEKGYIVGNISKDLALEPRELAERRVRIVSRGRTQLFSLNPRSGTLVTAGRIDREELCAQSPRCLVNFKVLVEDRVKLYGIEIEVTDINDSAPKFQAESLEVKINEIAVPGARYPLPEAIDPDVGVNSLQSYQLSPNHHFSLNVQTGDNGAINPELVLERALDREEATAHHLVLTASDGGEPRRSSTVRIHVTVLDTNDNAPVFAQRIYRVKVLENVPPGTWLLTATASDLDEGINGKVAYKFWKINEKQSLLFQLNENTGEISTAKSLDYEECSFYEMEIQAEDGGGLKGWTKVLISVEDVNDNRPEVTITSLFSPVREDAPQGTVILLFNAHDRDSGKNGQVVCSIQENLSFTLENSEEDYYRLLTAQILDREKASEYNITVTATDRGTPPLSTEIHITLQVTDINDNPPAFSQASYSVYLPENNARGTSIFSVIAYDPDSNENSRVIYSLAEDTIQGSPLSTYVSINSDTGVLYALCSFDYEQFRDLQMQVTASDSGSPPLSSNVSLRLFVLDQNDNAPEILYPALPTDGSTGVELAPRSAEPGYLVTKVVAVDRDSGQNAWLSYRLFKASEPGLFSVGLHTGEVRTARALLDRDALKQSLVVAVQDHGQPPLSATVTLTVAIADSIPDILADLGSLQIPADLEASDLTLYLVVAVAVVSCVFLTFVITLLALRLRHWHSSHLLRATSDGLAGVPTSHFVGVDGVRAFLQTYSQEFSLTADSRKSHLIFPQPNYADTLISQQSCEKNEPLCVSVDSKFPIEDTPLVPQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69741 - protein, 828 aa, Homo sapiens
  Payload ID: 13853
  Gene Symbol: PCDHGA9
  Gene Name: protocadherin gamma subfamily A, 9
  Uniprot ID: Q9Y5G4
  ENSP ID: ENSP00000480862
MAAPTKCQLRGRLVLLCSLLGMLWEARASQIRYSVPEETEKGYIVGNISKDLALEPRELAERRVRIVSRGRTQLFSLNPRSGTLVTAGRIDREELCAQSPRCLVNFKVLVEDRVKLYGIEIEVTDINDSAPKFQAESLEVKINEIAVPGARYPLPEAIDPDVGVNSLQSYQLSPNHHFSLNVQTGDNGAINPELVLERALDREEATAHHLVLTASDGGEPRRSSTVRIHVTVLDTNDNAPVFAQRIYRVKVLENVPPGTWLLTATASDLDEGINGKVAYKFWKINEKQSLLFQLNENTGEISTAKSLDYEECSFYEMEIQAEDGGGLKGWTKVLISVEDVNDNRPEVTITSLFSPVREDAPQGTVILLFNAHDRDSGKNGQVVCSIQENLSFTLENSEEDYYRLLTAQILDREKASEYNITVTATDRGTPPLSTEIHITLQVTDINDNPPAFSQASYSVYLPENNARGTSIFSVIAYDPDSNENSRVIYSLAEDTIQGSPLSTYVSINSDTGVLYALCSFDYEQFRDLQMQVTASDSGSPPLSSNVSLRLFVLDQNDNAPEILYPALPTDGSTGVELAPRSAEPGYLVTKVVAVDRDSGQNAWLSYRLFKASEPGLFSVGLHTGEVRTARALLDRDALKQSLVVAVQDHGQPPLSATVTLTVAIADSIPDILADLGSLQIPADLEASDLTLYLVVAVAVVSCVFLTFVITLLALRLRHWHSSHLLRATSDGLAGVPTSHFVGVDGVRAFLQTYSQEFSLTADSRKSHLIFPQPNYADTLISQQSCEKNEPLCVSVDSKFPIEDTPLVPVSSFFFFLSFLFLFFVLFCF

SEQ ID NO: 69742 - protein, 927 aa, Homo sapiens
  Payload ID: 13854
  Gene Symbol: PCDHGB1
  Gene Name: protocadherin gamma subfamily B, 1
  Uniprot ID: Q9Y5G3
  ENSP ID: ENSP00000429273
MQRAREAEMMKSQVLFPFLLSLFCGAISQQIRYTIPEELANGSRVGKLAKDLGLSVRELPTRKLRVSAEDYFNVSLESGDLLVNGRIDREKICGRKLECALEFETVAENPMNVFHVVVVIQDINDNAPRFVAKGIDLEICESALPGVKFSLDSAQDADVEGNSLKLYTINPNQYFSLSTKESPDGSKYPVLLLEKPLDREHQSSHRLILTAMDGGDPPLSGTTHIWIRVTDANDNAPVFSQEVYRVSLQENVPWGTSVLRVMATDQDEGINAEITYAFLNSPISTSLFNLNPNTGDITTNGTLDFEETSRYVLSVEAKDGGVHTAHCNVQIEIVDENDNAPEVTFMSFSNQIPEDSDLGTVIALIKVRDKDSGQNGMVTCYTQEEVPFKLESTSKNYYKLVIAGALNREQTADYNVTIIATDKGKPALSSRTSITLHISDINDNAPVFHQASYVVHVSENNPPGASIAQVSASDPDLGPNGRVSYSILASDLEPRELLSYVSVSPQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRPEPSDPQTELQFYLVVALALISVLFLLAVILAIALRLRRSSSLDTEGCFQTGLCSKSGPGVPPNHSEGTLPYSYNLCIASHSAKTEFNSLNLTPEMAPPQDLLCDDPSMVVCASNEDHKIAYDPSLSSHQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69743 - protein, 810 aa, Homo sapiens
  Payload ID: 13854
  Gene Symbol: PCDHGB1
  Gene Name: protocadherin gamma subfamily B, 1
  Uniprot ID: Q9Y5G3
  ENSP ID: ENSP00000478900
MQRAREAEMMKSQVLFPFLLSLFCGAISQQIRYTIPEELANGSRVGKLAKDLGLSVRELPTRKLRVSAEDYFNVSLESGDLLVNGRIDREKICGRKLECALEFETVAENPMNVFHVVVVIQDINDNAPRFVAKGIDLEICESALPGVKFSLDSAQDADVEGNSLKLYTINPNQYFSLSTKESPDGSKYPVLLLEKPLDREHQSSHRLILTAMDGGDPPLSGTTHIWIRVTDANDNAPVFSQEVYRVSLQENVPWGTSVLRVMATDQDEGINAEITYAFLNSPISTSLFNLNPNTGDITTNGTLDFEETSRYVLSVEAKDGGVHTAHCNVQIEIVDENDNAPEVTFMSFSNQIPEDSDLGTVIALIKVRDKDSGQNGMVTCYTQEEVPFKLESTSKNYYKLVIAGALNREQTADYNVTIIATDKGKPALSSRTSITLHISDINDNAPVFHQASYVVHVSENNPPGASIAQVSASDPDLGPNGRVSYSILASDLEPRELLSYVSVSPQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRPEPSDPQTELQFYLVVALALISVLFLLAVILAIALRLRRSSSLDTEGCFQTGLCSKSGPGVPPNHSEGTLPYSYNLCIASHSAKTEFNSLNLTPEMAPPQDLLCDDPSMVVCASNEDHKIAYDPSLSSHVSFCKSS

SEQ ID NO: 69744 - protein, 931 aa, Homo sapiens
  Payload ID: 13855
  Gene Symbol: PCDHGB2
  Gene Name: protocadherin gamma subfamily B, 2
  Uniprot ID: Q9Y5G2
  ENSP ID: ENSP00000429018
MKASSGRCGLVRWLQVLLPFLLSLFPGALPVQIRYSIPEELAKNSVVGNLAKDLGLSVRDLPARKLRVSAEKEYFTVNPESGDLLVSDRIDREQICGKQPLCVLDFDTVAENPLNIFYIAVIVQDINDNTPLFKQTKINLKIGESTKPGTTFPLDPALDSDVGPNSLQRYHLNDNEYFDLAEKQTPDGRKYPELILKHSLDREEHSLHQLVLTAVDGGDPPQSGTTQIRIKVTDANDNPPVFSQDVYRVTLREDVPPGFFVLQVTATDRDEGINAEITYSFHNVDEQVKHFFNLNEKTGEITTKDDLDFEIASSYTLSIEAKDPGDLAAHCSIQVEILDDNDCAPEVIVTSVSTPLPEDSPPGTVIALIKTRDRDSGENGEVYCQVLGNAKFILKSSSKNYYKLVTDGALDREEIPEYNLTITATDGGKPPLSSSIIVTLHISDVNDNAPVFQQTSYMVHVAENNPPGASIAQISASDPDLGPSGQVSYSIVASDLKPREILSYVSVSAQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRREPSDPQAKLQFYLVVALALISVLFFLAVILAISLRLRLSSRSDAWDCFQPGLSSKPGPGVLPNYSEGTLPYSYNLCVASQSAKTEFNFLNITPELVPAQDLVCDNASWEQNTNHGAAGVPFASDTILKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69745 - protein, 811 aa, Homo sapiens
  Payload ID: 13855
  Gene Symbol: PCDHGB2
  Gene Name: protocadherin gamma subfamily B, 2
  Uniprot ID: Q9Y5G2
  ENSP ID: ENSP00000481512
MKASSGRCGLVRWLQVLLPFLLSLFPGALPVQIRYSIPEELAKNSVVGNLAKDLGLSVRDLPARKLRVSAEKEYFTVNPESGDLLVSDRIDREQICGKQPLCVLDFDTVAENPLNIFYIAVIVQDINDNTPLFKQTKINLKIGESTKPGTTFPLDPALDSDVGPNSLQRYHLNDNEYFDLAEKQTPDGRKYPELILKHSLDREEHSLHQLVLTAVDGGDPPQSGTTQIRIKVTDANDNPPVFSQDVYRVTLREDVPPGFFVLQVTATDRDEGINAEITYSFHNVDEQVKHFFNLNEKTGEITTKDDLDFEIASSYTLSIEAKDPGDLAAHCSIQVEILDDNDCAPEVIVTSVSTPLPEDSPPGTVIALIKTRDRDSGENGEVYCQVLGNAKFILKSSSKNYYKLVTDGALDREEIPEYNLTITATDGGKPPLSSSIIVTLHISDVNDNAPVFQQTSYMVHVAENNPPGASIAQISASDPDLGPSGQVSYSIVASDLKPREILSYVSVSAQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRREPSDPQAKLQFYLVVALALISVLFFLAVILAISLRLRLSSRSDAWDCFQPGLSSKPGPGVLPNYSEGTLPYSYNLCVASQSAKTEFNFLNITPELVPAQDLVCDNASWEQNTNHGAAGVPFASDTILKVSFN

SEQ ID NO: 69746 - protein, 929 aa, Homo sapiens
  Payload ID: 13856
  Gene Symbol: PCDHGB3
  Gene Name: protocadherin gamma subfamily B, 3
  Uniprot ID: Q9Y5G1
  ENSP ID: ENSP00000461862
MGNSSGWRGPAGQRRMLFLFLLSLLDQALSEPIRYAIPEELDRGSLVGNLAKDLGFGVGDLPTRNLRVIAEKKFFTVSPENGNLLVSDRIDREEICGKKSTCVLEFEMVAEKPLNFFHVTVLIQDINDNPPTFSQNITELEISELALTGATFALESAQDPDVGVNSLQQYYLSPDPHFSLIQKENLDGSRYPELVLKAPLDREEQPHHHLVLTAVDGGEPSRSCTTQIRVIVADANDNPPVFTQDMYRVNVAENLPAGSSVLKVMAIDMDEGINAEIIYAFINIGKEVRQLFKLDSKTGELTTIGELDFEERDSYTIGVEAKDGGHHTAYCKVQIDISDENDNAPEITLASESQHIQEDAELGTAVALIKTHDLDSGFNGEILCQLKGNFPFKIVQDTKNTYRLVTDGALDREQIPEYNVTITATDKGNPPLSSSKTITLHILDVNDNVPVFHQASYTVHVAENNPPGASIAHVRASDPDLGPNGLVSYYIVASDLEPRELSSYVSVSARSGVVFAQRAFDHEQLRAFELTLQARDQGSPTLSANVSLRVLVDDRNDNAPLVLYPALGPEGSALFDMVPRSAEPGYLVTKVVAVDADSGYNAWLSYHIVQASEPGLFSLGLRTGEVRTARTLGDREAARQRLLVTVRDGGQQPLSATVMLHLIFADSLQEIQPDLSDRPTPSDPQAELQFHLVVALALISVLFLLAVILAISLRLRCSSRPATEGYFQPGVCFKTVPGVLPTYSERTLPYSYNPCAASHSSNTEFKFLNIKAENAAPQDLLCDEASWFESNDNPEMPSNSGNLQKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69747 - protein, 814 aa, Homo sapiens
  Payload ID: 13856
  Gene Symbol: PCDHGB3
  Gene Name: protocadherin gamma subfamily B, 3
  ENSP ID: ENSP00000483339
MGNSSGWRGPAGQRRMLFLFLLSLLDQALSEPIRYAIPEELDRGSLVGNLAKDLGFGVGDLPTRNLRVIAEKKFFTVSPENGNLLVSDRIDREEICGKKSTCVLEFEMVAEKPLNFFHVTVLIQDINDNPPTFSQNITELEISELALTGATFALESAQDPDVGVNSLQQYYLSPDPHFSLIQKENLDGSRYPELVLKAPLDREEQPHHHLVLTAVDGGEPSRSCTTQIRVIVADANDNPPVFTQDMYRVNVAENLPAGSSVLKVMAIDMDEGINAEIIYAFINIGKEVRQLFKLDSKTGELTTIGELDFEERDSYTIGVEAKDGGHHTAYCKVQIDISDENDNAPEITLASESQHIQEDAELGTAVALIKTHDLDSGFNGEILCQLKGNFPFKIVQDTKNTYRLVTDGALDREQIPEYNVTITATDKGNPPLSSSKTITLHILDVNDNVPVFHQASYTVHVAENNPPGASIAHVRASDPDLGPNGLVSYYIVASDLEPRELSSYVSVSARSGVVFAQRAFDHEQLRAFELTLQARDQGSPTLSANVSLRVLVDDRNDNAPLVLYPALGPEGSALFDMVPRSAEPGYLVTKVVAVDADSGYNAWLSYHIVQASEPGLFSLGLRTGEVRTARTLGDREAARQRLLVTVRDGGQQPLSATVMLHLIFADSLQEIQPDLSDRPTPSDPQAELQFHLVVALALISVLFLLAVILAISLRLRCSSRPATEGYFQPGVCFKTVPGVLPTYSERTLPYSYNPCAASHSSNTEFKFLNIKAENAAPQDLLCDEASWFESNDNPEMPSNSGNLQKVSFFKPFLP

SEQ ID NO: 69748 - protein, 923 aa, Homo sapiens
  Payload ID: 13857
  Gene Symbol: PCDHGB4
  Gene Name: protocadherin gamma subfamily B, 4
  Uniprot ID: Q9UN71
  ENSP ID: ENSP00000428288
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFYLVVALALISVLFLVAMILAIALRLRRSSSPASWSCFQPGLCVKSESVVPPNYSEGTLPYSYNLCVAHTGKTEFNFLKCSEQLSSGQDILCGDSSGALFPLCNSSELTSHQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69749 - protein, 803 aa, Homo sapiens
  Payload ID: 13857
  Gene Symbol: PCDHGB4
  Gene Name: protocadherin gamma subfamily B, 4
  Uniprot ID: Q9UN71
  ENSP ID: ENSP00000484560
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFYLVVALALISVLFLVAMILAIALRLRRSSSPASWSCFQPGLCVKSESVVPPNYSEGTLPYSYNLCVAHTGKTEFNFLKCSEQLSSGQDILCGDSSGALFPLCNSSELTSHQVSFL

SEQ ID NO: 69750 - protein, 923 aa, Homo sapiens
  Payload ID: 13858
  Gene Symbol: PCDHGB5
  Gene Name: protocadherin gamma subfamily B, 5
  Uniprot ID: Q9Y5G0
  ENSP ID: ENSP00000478258
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILEVAEDADIGLNSLQKYKLSLNPSFSLIIKEKQDGSKYPELALEKTLDREQQSYHRLVLTALDGGHPPLSGTTELRIQVTDANDNPPVFNRDVYRVSLRENVPPGTTVLQVSATDQDEGINSEITYSFYRTGQIFSLNSKSGEITTQKKLDFEETKEYSMVVEGRDGGGLVAQCTVEINIQDENDNSPEVTFHSLLEMILENAVPGTLIALIKIHDQDSGENGEVNCQLQGEVPFKIISSSKNSYKLVTDGTLDREQTPEYNVTITATDRGKPPLSSSISVILHIRDVNDNAPVFHQASYLVSVPENNPPGASIAQVCASDLDLGLNGQVSYSIMASDLEPLALASYVSMSAQSGVVFAQRAFDYEQLRTFELTLQARDQGSPALSANVSLRVLVGDRNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLVFADSLQEVLPDITDRPVPSDPQAELQFYLVVALALISVLFLLAVILAVALRLRRSSSPAAWSCFQPGLCVKSGPVVPPNYSQGTLPYSYNLCVAHTGKTEFNFLKCSEQLSSGQDILCGDSSGALFPLCNSSESTSHPELQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69751 - protein, 818 aa, Homo sapiens
  Payload ID: 13858
  Gene Symbol: PCDHGB5
  Gene Name: protocadherin gamma subfamily B, 5
  Uniprot ID: Q9Y5G0
  ENSP ID: ENSP00000484888
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILEVAEDADIGLNSLQKYKLSLNPSFSLIIKEKQDGSKYPELALEKTLDREQQSYHRLVLTALDGGHPPLSGTTELRIQVTDANDNPPVFNRDVYRVSLRENVPPGTTVLQVSATDQDEGINSEITYSFYRTGQIFSLNSKSGEITTQKKLDFEETKEYSMVVEGRDGGGLVAQCTVEINIQDENDNSPEVTFHSLLEMILENAVPGTLIALIKIHDQDSGENGEVNCQLQGEVPFKIISSSKNSYKLVTDGTLDREQTPEYNVTITATDRGKPPLSSSISVILHIRDVNDNAPVFHQASYLVSVPENNPPGASIAQVCASDLDLGLNGQVSYSIMASDLEPLALASYVSMSAQSGVVFAQRAFDYEQLRTFELTLQARDQGSPALSANVSLRVLVGDRNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLVFADSLQEVLPDITDRPVPSDPQAELQFYLVVALALISVLFLLAVILAVALRLRRSSSPAAWSCFQPGLCVKSGPVVPPNYSQGTLPYSYNLCVAHTGKTEFNFLKCSEQLSSGQDILCGDSSGALFPLCNSSESTSHPELVSFIYVYSFSLPTQFSVFT

SEQ ID NO: 69752 - protein, 930 aa, Homo sapiens
  Payload ID: 13859
  Gene Symbol: PCDHGB6
  Gene Name: protocadherin gamma subfamily B, 6
  Uniprot ID: Q9Y5F9
  ENSP ID: ENSP00000428603
MGGSCAQRRRAGPRQVLFPLLLPLFYPTLSEPIRYSIPEELAKGSVVGNLAKDLGLSVLDVSARKLRVSAEKLHFSVDAESGDLLVKNRIDREQICKERRRCELQLEAVVENPLNIFHVIVVIEDVNDHAPQFDKKEIHLEIFESASAGTRLSLDPATDPDININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYSSSNNYYKLVTDGALDREQTPEYNVTIVATDRGKPPLSSSRSITLYVADINDNAPVFDQTSYVVHVAENNPPGASIAQVSASDPDLGLNGHISYSIVASDLEPLAVSSYVSVSAQSGVVFAQRAFDHEQLRAFALTLQARDHGSPTLSANVSLRVLVGDRNDNAPRVLYPALGPDGSAFFDMVPRSAEPGYLVTKVVAVDADSGHNAWLSYHVLQASEPGLFSLGLRTGEVRTARALGDRDAARQRLLVAVRDGGQPPLSATATLHLVFADNLQEILPDLSDRPVLSDPQAELQFYLVVALALISVLFLLAVILAIALRLRRSLSPATWDCFHPGLCVKSGPVVPPNYSEGTLPYSYNLCIAHTGTKEFNFLKCSVPLHSNEDMVCSVSPGALIPPHGGEDLTSHPETLTSQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69753 - protein, 820 aa, Homo sapiens
  Payload ID: 13859
  Gene Symbol: PCDHGB6
  Gene Name: protocadherin gamma subfamily B, 6
  Uniprot ID: Q9Y5F9
  ENSP ID: ENSP00000479143
MGGSCAQRRRAGPRQVLFPLLLPLFYPTLSEPIRYSIPEELAKGSVVGNLAKDLGLSVLDVSARKLRVSAEKLHFSVDAESGDLLVKNRIDREQICKERRRCELQLEAVVENPLNIFHVIVVIEDVNDHAPQFDKKEIHLEIFESASAGTRLSLDPATDPDININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYSSSNNYYKLVTDGALDREQTPEYNVTIVATDRGKPPLSSSRSITLYVADINDNAPVFDQTSYVVHVAENNPPGASIAQVSASDPDLGLNGHISYSIVASDLEPLAVSSYVSVSAQSGVVFAQRAFDHEQLRAFALTLQARDHGSPTLSANVSLRVLVGDRNDNAPRVLYPALGPDGSAFFDMVPRSAEPGYLVTKVVAVDADSGHNAWLSYHVLQASEPGLFSLGLRTGEVRTARALGDRDAARQRLLVAVRDGGQPPLSATATLHLVFADNLQEILPDLSDRPVLSDPQAELQFYLVVALALISVLFLLAVILAIALRLRRSLSPATWDCFHPGLCVKSGPVVPPNYSEGTLPYSYNLCIAHTGTKEFNFLKCSVPLHSNEDMVCSVSPGALIPPHGGEDLTSHPETLTSVSFSFLCVIYLIVY

SEQ ID NO: 69754 - protein, 929 aa, Homo sapiens
  Payload ID: 13860
  Gene Symbol: PCDHGB7
  Gene Name: protocadherin gamma subfamily B, 7
  Uniprot ID: Q9Y5F8
  ENSP ID: ENSP00000381594
MGGSCAQRRRAGPRQVLFPLLLPLFYPTLCEPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFYLVVALALISVLFLLAVILAIALRLRQSFSPTAGDCFESVLCSKSGPVGPPNYSEGTLPYAYNFCVPGDQMNPEFNFFTSVDHCPATQDNLNKDSMLLASILTPSVEADKKILKQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69755 - protein, 808 aa, Homo sapiens
  Payload ID: 13860
  Gene Symbol: PCDHGB7
  Gene Name: protocadherin gamma subfamily B, 7
  Uniprot ID: Q9Y5F8
  ENSP ID: ENSP00000479132
MGGSCAQRRRAGPRQVLFPLLLPLFYPTLCEPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFYLVVALALISVLFLLAVILAIALRLRQSFSPTAGDCFESVLCSKSGPVGPPNYSEGTLPYAYNFCVPGDQMNPEFNFFTSVDHCPATQDNLNKDSMLLASILTPSVEADKKILKQVSI

SEQ ID NO: 69756 - protein, 934 aa, Homo sapiens
  Payload ID: 13861
  Gene Symbol: PCDHGC3
  Gene Name: protocadherin gamma subfamily C, 3
  Uniprot ID: Q9UN70
  ENSP ID: ENSP00000312070
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69757 - protein, 863 aa, Homo sapiens
  Payload ID: 13861
  Gene Symbol: PCDHGC3
  Gene Name: protocadherin gamma subfamily C, 3
  Uniprot ID: Q9UN70
  ENSP ID: ENSP00000481219
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQVRFSKSCLTLLVLFYSYIILRKEWSCFFSDEDVFLVMHSHFQLALPRSKLVPL

SEQ ID NO: 69758 - protein, 185 aa, Homo sapiens
  Payload ID: 13861
  Gene Symbol: PCDHGC3
  Gene Name: protocadherin gamma subfamily C, 3
  ENSP ID: ENSP00000481673
MVPEAWRSGLVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69759 - protein, 134 aa, Homo sapiens
  Payload ID: 13861
  Gene Symbol: PCDHGC3
  Gene Name: protocadherin gamma subfamily C, 3
  ENSP ID: ENSP00000483383
MVPEAWRSGLQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69760 - protein, 242 aa, Homo sapiens
  Payload ID: 13861
  Gene Symbol: PCDHGC3
  Gene Name: protocadherin gamma subfamily C, 3
  ENSP ID: ENSP00000484352
MVPEAWRSGLEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTV

SEQ ID NO: 69761 - protein, 938 aa, Homo sapiens
  Payload ID: 13862
  Gene Symbol: PCDHGC4
  Gene Name: protocadherin gamma subfamily C, 4
  Uniprot ID: Q9Y5F7
  ENSP ID: ENSP00000306918
MLRKVRSWTEIWRWATLLFLFYHLGYVCGQIRYPVPEESQEGTFVGNVAQDFLLDTDSLSARRLQVAGEVNQRHFRVDLDSGALLIKNPIDREALCGLSASCIVPLEFVTEGPLEMYRAEVEIVDVNDHAPRFPRQQLDLEIGEAAPPGQRFPLEKAQDADVGSNSISSYRLSSNEHFALDVKKRSDGSLVPELLLEKPLDREKQSDYRLVLTAVDGGNPPRSGTAELRVSVLDVNDNAPAFQQSSYRISVLESAPAGMVLIQLNASDPDLGPSGNVTFYFSGHTPDRVRNLFSLHPTTGKLTLLGPLDFESENYYEFDVRARDGGSPAMEQHCSLRVDLLDVNDNAPYITVTSELGTLPESAEPGTVVALISVQDPDSGSNGDVSLRIPDHLPFALKSAFRNQFSLVTAGPLDREAKSSYDIMVTASDAGNPPLSTHRTIFLNISDVNDNPPSFFQRSHEVFVPENNRPGDLLCSLAASDPDSGLNALISYSLLEPRNRDVSASSFISLNPQTGAVHATRSFDYEQTQTLQFEVQARDRGNPPLSSTVTVRLFVLDLNDNAPAVLRPRARPGSLCPQALPPSVGAGHLITKVTAVDLDSGYNAWVSYQLLEAPDPSLFAVSRYAGEVRTAVPIPADLPPQKLVIVVKDSGSPPLSTSVTLLVSLEEDTHPVVPDLRESSAPREGESRLTLYLAVSLVAICFVSFGSFVALLSKCLRGAACGVTCFPAGTCACLTRSRRREGLPPSNGILRIQLGSDDPIKFVDVGGHSHGCTPLASAPTRSDSFMMVKSPSAPMAGEPVRPSCPPSDLLYGLEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69762 - protein, 83 aa, Homo sapiens
  Payload ID: 13862
  Gene Symbol: PCDHGC4
  Gene Name: protocadherin gamma subfamily C, 4
  ENSP ID: ENSP00000478393
MYRAEVEIVDVNDHAPRFPRQQLDLEIGEAAPPGQRFPLEKAQDADVGSNSISSYRLSSNEHFALDVKKRSDGSLVPELLLEK

SEQ ID NO: 69763 - protein, 128 aa, Homo sapiens
  Payload ID: 13862
  Gene Symbol: PCDHGC4
  Gene Name: protocadherin gamma subfamily C, 4
  ENSP ID: ENSP00000478541
MLRKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69764 - protein, 871 aa, Homo sapiens
  Payload ID: 13862
  Gene Symbol: PCDHGC4
  Gene Name: protocadherin gamma subfamily C, 4
  Uniprot ID: Q9Y5F7
  ENSP ID: ENSP00000483845
MLRKVRSWTEIWRWATLLFLFYHLGYVCGQIRYPVPEESQEGTFVGNVAQDFLLDTDSLSARRLQVAGEVNQRHFRVDLDSGALLIKNPIDREALCGLSASCIVPLEFVTEGPLEMYRAEVEIVDVNDHAPRFPRQQLDLEIGEAAPPGQRFPLEKAQDADVGSNSISSYRLSSNEHFALDVKKRSDGSLVPELLLEKPLDREKQSDYRLVLTAVDGGNPPRSGTAELRVSVLDVNDNAPAFQQSSYRISVLESAPAGMVLIQLNASDPDLGPSGNVTFYFSGHTPDRVRNLFSLHPTTGKLTLLGPLDFESENYYEFDVRARDGGSPAMEQHCSLRVDLLDVNDNAPYITVTSELGTLPESAEPGTVVALISVQDPDSGSNGDVSLRIPDHLPFALKSAFRNQFSLVTAGPLDREAKSSYDIMVTASDAGNPPLSTHRTIFLNISDVNDNPPSFFQRSHEVFVPENNRPGDLLCSLAASDPDSGLNALISYSLLEPRNRDVSASSFISLNPQTGAVHATRSFDYEQTQTLQFEVQARDRGNPPLSSTVTVRLFVLDLNDNAPAVLRPRARPGSLCPQALPPSVGAGHLITKVTAVDLDSGYNAWVSYQLLEAPDPSLFAVSRYAGEVRTAVPIPADLPPQKLVIVVKDSGSPPLSTSVTLLVSLEEDTHPVVPDLRESSAPREGESRLTLYLAVSLVAICFVSFGSFVALLSKCLRGAACGVTCFPAGTCACLTRSRRREGLPPSNGILRIQLGSDDPIKFVDVGGHSHGCTPLASAPTRSDSFMMVKSPSAPMAGEPVRPSCPPSDLLYGLEVRPLQAQQMLEGYSDPGIWLGHVLESTGLSVSAHSDVTIFVRGNYVVDAVLCNCFVN

SEQ ID NO: 69765 - protein, 944 aa, Homo sapiens
  Payload ID: 13863
  Gene Symbol: PCDHGC5
  Gene Name: protocadherin gamma subfamily C, 5
  Uniprot ID: Q9Y5F6
  ENSP ID: ENSP00000252087
MGPKTLPQLAGKWQVLCMLSLCCWGWVSGQLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPRFNQQLYTAYILENRPPGSLLCTVAASDPDTGDNARLTYSIVGNQVQGAPASSFVYVNPEDGRIFAQRTFDYELLQMLQIVVGVRDSGSPPLHANTSLHVFVLDENDNAPAVLHPRPDWEHSAPQRLPRSAPPGSLVTKVTAVDADAGHNAWLSYSLLPQSTAPGLFLVSTHTGEVRTARALLEDDSDTQQVVVLVRDNGDPSLSSTATVLLVLEDEDPEEMPKSSDFLIHPPERSDLTLYLIVALATVSLLSLVTFTFLSAKCLQGNADGDGGGGQCCRRQDSPSPDFYKQSSPNLQVSSDGTLKYMEVTLRPTDSQSHCYRTCFSPASDGSDFTFLRPLSVQQPTALALEPDAIRSRSNTLRERSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 69766 - protein, 878 aa, Homo sapiens
  Payload ID: 13863
  Gene Symbol: PCDHGC5
  Gene Name: protocadherin gamma subfamily C, 5
  Uniprot ID: Q9Y5F6
  ENSP ID: ENSP00000482569
MGPKTLPQLAGKWQVLCMLSLCCWGWVSGQLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPRFNQQLYTAYILENRPPGSLLCTVAASDPDTGDNARLTYSIVGNQVQGAPASSFVYVNPEDGRIFAQRTFDYELLQMLQIVVGVRDSGSPPLHANTSLHVFVLDENDNAPAVLHPRPDWEHSAPQRLPRSAPPGSLVTKVTAVDADAGHNAWLSYSLLPQSTAPGLFLVSTHTGEVRTARALLEDDSDTQQVVVLVRDNGDPSLSSTATVLLVLEDEDPEEMPKSSDFLIHPPERSDLTLYLIVALATVSLLSLVTFTFLSAKCLQGNADGDGGGGQCCRRQDSPSPDFYKQSSPNLQVSSDGTLKYMEVTLRPTDSQSHCYRTCFSPASDGSDFTFLRPLSVQQPTALALEPDAIRSRSNTLRERSQVRGSAPPRATPGGGTGEAARPHKGLNLHPLLSGRLGRWLRSTRFSGSLDRLRETRVAD

SEQ ID NO: 69767 - protein, 951 aa, Homo sapiens; identical to SEQ ID NO: 69633
  Payload ID: 13864
  Gene Symbol:
  Gene Name: Protocadherin-20  [Source:UniProtKB/Swiss-Prot
  Acc:Q8N6Y1]
  Uniprot ID: Q8N6Y1
  ENSP ID: ENSP00000386653

SEQ ID NO: 69768 - protein, 1955 aa, Homo sapiens
  Payload ID: 13865
  Gene Symbol: PCDH15
  Gene Name: protocadherin-related 15
  Uniprot ID: Q96QU1
  ENSP ID: ENSP00000322604
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69769 - protein, 1957 aa, Homo sapiens
  Payload ID: 13865
  Gene Symbol: PCDH15
  Gene Name: protocadherin-related 15
  ENSP ID: ENSP00000354950
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69770 - protein, 961 aa, Homo sapiens
  Payload ID: 13865
  Gene Symbol: PCDH15
  Gene Name: protocadherin-related 15
  Uniprot ID: Q96QU1
  ENSP ID: ENSP00000363066
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPVSRRH

SEQ ID NO: 69771 - protein, 654 aa, Homo sapiens
  Payload ID: 13865
  Gene Symbol: PCDH15
  Gene Name: protocadherin-related 15
  ENSP ID: ENSP00000363067
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQHGDSNLRESTGQGKH

SEQ ID NO: 69772 - protein, 1962 aa, Homo sapiens
  Payload ID: 13865
  Gene Symbol: PCDH15
  Gene Name: protocadherin-related 15
  ENSP ID: ENSP00000363068
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69773 - protein, 1677 aa, Homo sapiens
  Payload ID: 13865
  Gene Symbol: PCDH15
  Gene Name: protocadherin-related 15
  ENSP ID: ENSP00000363076
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 69774 - protein, 1952 aa, Homo sapiens
  Payload ID: 13865
  Gene Symbol: PCDH15
  Gene Name: protocadherin-related 15
  ENSP ID: ENSP00000378818
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69775 - protein, 1915 aa, Homo sapiens
  Payload ID: 13865
  Gene Symbol: PCDH15
  Gene Name: protocadherin-related 15
  ENSP ID: ENSP00000378820
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69776 - protein, 1932 aa, Homo sapiens
  Payload ID: 13865
  Gene Symbol: PCDH15
  Gene Name: protocadherin-related 15
  ENSP ID: ENSP00000378821
MFRQFYLWTCLASGIILGSLFEICLGQYDDGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69777 - protein, 1540 aa, Homo sapiens
  Payload ID: 13865
  Gene Symbol: PCDH15
  Gene Name: protocadherin-related 15
  ENSP ID: ENSP00000378826
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMNRNYPWSLELILARNMDKIITVMSMGMKCLNMGVAVDCYHQLDRRNMVRWLVKLRKNMRRKRKSQRKLKNQRLKLESLVRRKK

SEQ ID NO: 69778 - protein, 719 aa, Homo sapiens
  Payload ID: 13865
  Gene Symbol: PCDH15
  Gene Name: protocadherin-related 15
  ENSP ID: ENSP00000378827
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 69779 - protein, 650 aa, Homo sapiens
  Payload ID: 13865
  Gene Symbol: PCDH15
  Gene Name: protocadherin-related 15
  ENSP ID: ENSP00000378829
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 69780 - protein, 1783 aa, Homo sapiens
  Payload ID: 13865
  Gene Symbol: PCDH15
  Gene Name: protocadherin-related 15
  Uniprot ID: Q96QU1
  ENSP ID: ENSP00000378832
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 69781 - protein, 981 aa, Homo sapiens
  Payload ID: 13865
  Gene Symbol: PCDH15
  Gene Name: protocadherin-related 15
  ENSP ID: ENSP00000378833
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 69782 - protein, 1150 aa, Homo sapiens
  Payload ID: 13865
  Gene Symbol: PCDH15
  Gene Name: protocadherin-related 15
  ENSP ID: ENSP00000386693
MPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKNYPWSLELILARNMDKIITVMSMGMKCLNMGVAVDCYHQLDRRNMVRWLVKLRKNMRRKRKSQRKLKNQRLKLESLVRRKK

SEQ ID NO: 69783 - protein, 92 aa, Homo sapiens
  Payload ID: 13865
  Gene Symbol: PCDH15
  Gene Name: protocadherin-related 15
  ENSP ID: ENSP00000394465
MFRQFYLWTCLASGIILGSLFEICLGQYDDDCKLARGGPPATIVAIDEESRNGTILVDNMLIKGTAGGPDPTIELSLKDNVDYWVLMDPVKQ

SEQ ID NO: 69784 - protein, 1676 aa, Homo sapiens
  Payload ID: 13865
  Gene Symbol: PCDH15
  Gene Name: protocadherin-related 15
  ENSP ID: ENSP00000410304
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 69785 - protein, 654 aa, Homo sapiens; identical to SEQ ID NO: 69771
  Payload ID: 13865
  Gene Symbol: PCDH15
  Gene Name: protocadherin-related 15
  ENSP ID: ENSP00000412320

SEQ ID NO: 69786 - protein, 329 aa, Homo sapiens
  Payload ID: 13865
  Gene Symbol: PCDH15
  Gene Name: protocadherin-related 15
  ENSP ID: ENSP00000412531
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPDLGSLCSGTNSWCQGRSGVHWSSPAWRCLFPRRLHQM

SEQ ID NO: 69787 - protein, 1886 aa, Homo sapiens
  Payload ID: 13865
  Gene Symbol: PCDH15
  Gene Name: protocadherin-related 15
  ENSP ID: ENSP00000412628
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERSTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHNLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69788 - protein, 1539 aa, Homo sapiens
  Payload ID: 13865
  Gene Symbol: PCDH15
  Gene Name: protocadherin-related 15
  ENSP ID: ENSP00000478076
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKNYPWSLELILARNMDKIITVMSMGMKCLNMGVAVDCYHQLDRRNMVRWLVKLRKNMRRKRKSQRKLKNQRLKLESLVRRKK

SEQ ID NO: 69789 - protein, 1681 aa, Homo sapiens
  Payload ID: 13865
  Gene Symbol: PCDH15
  Gene Name: protocadherin-related 15
  ENSP ID: ENSP00000478512
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 69790 - protein, 37 aa, Homo sapiens
  Payload ID: 13865
  Gene Symbol: PCDH15
  Gene Name: protocadherin-related 15
  ENSP ID: ENSP00000478551
  MOD_RES (1)..(1): Any amino acid
XMKCLNMGVAVDCYHQLDRRNMVRWLVKLRKNMRRKR

SEQ ID NO: 69791 - protein, 416 aa, Homo sapiens
  Payload ID: 13865
  Gene Symbol: PCDH15
  Gene Name: protocadherin-related 15
  ENSP ID: ENSP00000480780
MQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQRGYGSEQQQLLRPSLLKPEELSMESGIDPGQEYGQDYYSYEHGYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 69792 - protein, 72 aa, Homo sapiens
  Payload ID: 13865
  Gene Symbol: PCDH15
  Gene Name: protocadherin-related 15
  ENSP ID: ENSP00000481211
MFRQFYLWTCLASGIILGSLFEICLGQYDDGTILVDNMLIKGTAGGPDPTIELSLKDNVDYWVLMDPVKQML

SEQ ID NO: 69793 - protein, 1888 aa, Homo sapiens
  Payload ID: 13865
  Gene Symbol: PCDH15
  Gene Name: protocadherin-related 15
  ENSP ID: ENSP00000482329
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERSTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSILSSLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69794 - protein, 460 aa, Homo sapiens
  Payload ID: 13865
  Gene Symbol: PCDH15
  Gene Name: protocadherin-related 15
  ENSP ID: ENSP00000482780
LVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMRGYGSEQQQLLRPSLLKPEELSMESGIDPGQEYGQDYYSYEHGYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 69795 - protein, 1790 aa, Homo sapiens
  Payload ID: 13865
  Gene Symbol: PCDH15
  Gene Name: protocadherin-related 15
  ENSP ID: ENSP00000482794
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 69796 - protein, 1789 aa, Homo sapiens
  Payload ID: 13865
  Gene Symbol: PCDH15
  Gene Name: protocadherin-related 15
  ENSP ID: ENSP00000482921
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDVPPSGVPTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSMYEMPQYGSRRRLLPPAGQEEYGEVVGEAEEEYEEEEEEPKKIKKPKVEIREPSEEEEVVVTIEKPPAAEPTYTTWKRARIFPMIFKKVRGLADKRGIVDLEGEEWQRRLEEEDKDYLKLTLDQEEATESTVESEEESSSDYTEYSEEESEFSESETTEEESESETPSEEEESSTPESEESESTESEGEKARKNIVLARRRPMVEEVKEVKGRKEEPQEEQKEPKMEEEEHSEEEESGPAPVEESTDPEAQDIPEEGSAESASVEGGVESEEESESGSSSSSSESQSGGPWGYQVPAYDRSKNANQKKSPGANSEGYNTAL

SEQ ID NO: 69797 - protein, 1675 aa, Homo sapiens
  Payload ID: 13865
  Gene Symbol: PCDH15
  Gene Name: protocadherin-related 15
  Uniprot ID: Q96QU1
  ENSP ID: ENSP00000483745
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 69798 - protein, 1682 aa, Homo sapiens
  Payload ID: 13865
  Gene Symbol: PCDH15
  Gene Name: protocadherin-related 15
  ENSP ID: ENSP00000484454
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSMHKYEMPQYGSRRRLLPPAGQEEYGEVVGEAEEEYEEEEWARKRMIKLVVDREYETSSTGEDSAPECQRNRLHHPSIHSNINGNIYIAQNGSVVRTRRACLTDNLKVASPVRLGGPFKKLDKLAVTHEENVPLNTLSKGPFSTEKMNARPTLVTFAPCPVGTDNTAVKPLRNRLKSTVEQESMIDSKNIKEALEFHSDHTQSDDEELWMGPWNNLHIPMTKL

SEQ ID NO: 69799 - protein, 1964 aa, Homo sapiens
  Payload ID: 13865
  Gene Symbol: PCDH15
  Gene Name: protocadherin-related 15
  ENSP ID: ENSP00000484703
MFRQFYLWTCLASGIILGSLFEICLGQYDDDWQYEDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQVFKGRQAECTKTARIQAALPAAKPAVPAPAPVAAPPPPPPPPPGAHLYEELGDSSILSSLFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 69800 - protein, 1150 aa, Homo sapiens
  Payload ID: 13866
  Gene Symbol: PRTG
  Gene Name: protogenin
  Uniprot ID: Q2VWP7
  ENSP ID: ENSP00000373937
MAPPLRPLARLRPPGMLLRALLLLLLLSPLPGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSTISAFEVQPISTEVHEGGVARFACKISSHPPAVITWEFNRTTLPMTMDRITALPTGVLQIYDVSQRDSGNYRCIAATVAHRRKSMEASLTVIPAKESKSFHTPTIIAGPQNITTSLHQTVVLECMATGNPKPIISWSRLDHKSIDVFNTRVLGNGNLMISDVRLQHAGVYVCRATTPGTRNFTVAMATLTVLAPPSFVEWPESLTRPRAGTARFVCQAEGIPSPKMSWLKNGRKIHSNGRIKMYNSKLVINQIIPEDDAIYQCMAENSQGSILSRARLTVVMSEDRPSAPYNVHAETMSSSAILLAWERPLYNSDKVIAYSVHYMKAEGLNNEEYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLDPRRKYHVRLLAYNNIDDGYQADQTVSTPGCVSVRDRMVPPPPPPHHLYAKANTSSSIFLHWRRPAFTAAQIINYTIRCNPVGLQNASLVLYLQTSETHMLVQGLEPNTKYEFAVRLHVDQLSSPWSPVVYHSTLPEAPAGPPVGVKVTLIEDDTALVSWKPPDGPETVVTRYTILYASRKAWIAGEWQVLHREGAITMALLENLVAGNVYIVKISASNEVGEGPFSNSVELAVLPKETSESNQRPKRLDSADAKVYSGYYHLDQKSMTGIAVGVGIALTCILICVLILIYRSKARKSSASKTAQNGTQQLPRTSASLASGNEVGKNLEGAVGNEESLMPMIMPNSFIDAKGGTDLIINSYGPIIKNNSKKKWFFFQDSKKIQVEQPQRRFTPAVCFYQPGTTVLISDEDSPSSPGQTTSFSRPFGVAADTEHSANSEGSHETGDSGRFSHESNDEIHLSSVISTTPPNL

SEQ ID NO: 69801 - protein, 22 aa, Homo sapiens
  Payload ID: 13866
  Gene Symbol: PRTG
  Gene Name: protogenin
  ENSP ID: ENSP00000452760
MSENKRIEVLSNGSLYISEVEG

SEQ ID NO: 69802 - protein, 218 aa, Homo sapiens
  Payload ID: 13866
  Gene Symbol: PRTG
  Gene Name: protogenin
  ENSP ID: ENSP00000453160
EYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLARI

SEQ ID NO: 69803 - protein, 137 aa, Homo sapiens
  Payload ID: 13866
  Gene Symbol: PRTG
  Gene Name: protogenin
  ENSP ID: ENSP00000453335
MAPPLRPLARLRPPGMLLRALLLLLLLSPLPGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSRIGST

SEQ ID NO: 69804 - protein, 477 aa, Homo sapiens
  Payload ID: 13867
  Gene Symbol: PPOX
  Gene Name: protoporphyrinogen oxidase
  Uniprot ID: P50336
  ENSP ID: ENSP00000343943
MGRTVVVLGGGISGLAASYHLSRAPCPPKVVLVESSERLGGWIRSVRGPNGAIFELGPRGIRPAGALGARTLLLVSELGLDSEVLPVRGDHPAAQNRFLYVGGALHALPTGLRGLLRPSPPFSKPLFWAGLRELTKPRGKEPDETVHSFAQRRLGPEVASLAMDSLCRGVFAGNSRELSIRSCFPSLFQAEQTHRSILLGLLLGAGRTPQPDSALIRQALAERWSQWSLRGGLEMLPQALETHLTSRGVSVLRGQPVCGLSLQAEGRWKVSLRDSSLEADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 69805 - protein, 477 aa, Homo sapiens; identical to SEQ ID NO: 69804
  Payload ID: 13867
  Gene Symbol: PPOX
  Gene Name: protoporphyrinogen oxidase
  Uniprot ID: P50336
  ENSP ID: ENSP00000356978

SEQ ID NO: 69806 - protein, 161 aa, Homo sapiens
  Payload ID: 13867
  Gene Symbol: PPOX
  Gene Name: protoporphyrinogen oxidase
  ENSP ID: ENSP00000438136
  MOD_RES (1)..(1): Any amino acid
XADHVISAIPASVLSELLPAEAAPLARALSAITAVSVAVVNLQYQGAHLPVQGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLGKLGKQLG

SEQ ID NO: 69807 - protein, 230 aa, Homo sapiens
  Payload ID: 13867
  Gene Symbol: PPOX
  Gene Name: protoporphyrinogen oxidase
  ENSP ID: ENSP00000439544
  MOD_RES (1)..(1): Any amino acid
XQAEQTHRSILLGLLLGAGRTPQPDSALIRQALAERWSQWSLRGGLEMLPQALETHLTSRGVSVLRGQPVCGLSLQAEGRWKGFGHLVPSSEDPGVLGIVYDSVAFPEQDGSPPGLRVTVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 69808 - protein, 113 aa, Homo sapiens
  Payload ID: 13867
  Gene Symbol: PPOX
  Gene Name: protoporphyrinogen oxidase
  ENSP ID: ENSP00000439613
MGRTVVVLGGGISGLAASYHLSRAPCPPKVVLVESSERLGGWIRSVRGPNGAIFELGPRGIRPAGALGARTLLLVSLRDSSLEADHVISAIPASGIWTFGAIFRRSRSPGNRV

SEQ ID NO: 69809 - protein, 156 aa, Homo sapiens
  Payload ID: 13867
  Gene Symbol: PPOX
  Gene Name: protoporphyrinogen oxidase
  ENSP ID: ENSP00000443769
MGRTVVVLGGGISGLAASYHLSRAPCPPKVMLGGSWLQTLEASGCVLSQELFQQRAQEAAATQLGLKEMPSHCLVHLHKTKNQLKWRQSHDRTVEWPKEYPGRSRKQAPSILHVPGCQLLRCRDRDHLGAVSEQPRSSAESRVGVASSTFSTFPLF

SEQ ID NO: 69810 - protein, 185 aa, Homo sapiens
  Payload ID: 13867
  Gene Symbol: PPOX
  Gene Name: protoporphyrinogen oxidase
  ENSP ID: ENSP00000444216
MGRTVVVLGGGISGLAASYHLSRAPCPPKVVLVESSERLGGWIRSVRGPNGAIFELGPRGIRPAGALGARTLLLVMLGGSWLQTLEASGCVLSQELFQQRAQEAAATQLGLKEMPSHCLVHLHKNCIPQYTLGHWQKLESARQFLTAHRLPLTLAGASYEGVAVNDCIESGRQAAVSVLGTEPNS

SEQ ID NO: 69811 - protein, 858 aa, Homo sapiens
  Payload ID: 13868
  Gene Symbol: PRPF40B
  Gene Name: PRP40 homolog, pre-mRNA processing factor B
  Uniprot ID: Q6NWY9
  ENSP ID: ENSP00000261897
MPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQTFLDELHETGQLHSMSTWMELYPAVSTDVRFANMLGQPGSTPLDLFKFYVEELKARFHDEKKIIKDILKVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLEQTECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 69812 - protein, 871 aa, Homo sapiens
  Payload ID: 13868
  Gene Symbol: PRPF40B
  Gene Name: PRP40 homolog, pre-mRNA processing factor B
  Uniprot ID: Q6NWY9
  ENSP ID: ENSP00000369634
MMPPPFMPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQTFLDELHETGQLHSMSTWMELYPAVSTDVRFANMLGQPGSTPLDLFKFYVEELKARFHDEKKIIKDILKDRGFCVEVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLEQTECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 69813 - protein, 892 aa, Homo sapiens
  Payload ID: 13868
  Gene Symbol: PRPF40B
  Gene Name: PRP40 homolog, pre-mRNA processing factor B
  ENSP ID: ENSP00000448073
MSVPDSGPRPPAAPAPFPPGPPMMPPPFMPPPGIPPPFPPMGLPPMSQRPPAIPPMPPGILPPMLPPMGAPPPLTQIPGMVPPMMPGMLMPAVPVTAATAPGADTASSAVAGTGPPRALWSEHVAPDGRIYYYNADDKQSVWEKPSVLKSKAELLLSQCPWKEYKSDTGKPYYYNNQSKESRWTRPKDLDDLEVLVKQEAAGKQQQQLPQTLQPQPPQPQPDPPPVPPGPTPVPTGLLEPEPGGSEDCDVLEATQPLEQGFLQQLEEGPSSSGQHQPQQEEEESKPEPERSGLSWSNREKAKQAFKELLRDKAVPSNASWEQAMKMVVTDPRYSALPKLSEKKQAFNAYKAQREKEEKEEARLRAKEAKQTLQHFLEQHERMTSTTRYRRAEQTFGELEVWAVVPERDRKEVYDDVLFFLAKKEKEQAKQLRRRNIQALKSILDGMSSVNFQTTWSQAQQYLMDNPSFAQDHQLQNMDKEDALICFEEHIRALEREEEEERERARLRERRQQRKNREAFQTFLDELHETGQLHSMSTWMELYPAVSTDVRFANMLGQPGSTPLDLFKFYVEELKARFHDEKKIIKDILKDRGFCVEVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLETECQHLHTKGRKHGRKGKKHHHKRSHSPSGSESEEEELPPPSLRPPKRRRRNPSESGSEPSSSLDSVESGGAALGGRGSPSSHLLGADHGLRKAKKPKKKTKKRRHKSNSPESETDPEEKAGKESDEKEQEQDKDRELQQAELPNRSPGFGIKKEKTGWDTSESELSEGELERRRRTLLQQLDDHQ

SEQ ID NO: 69814 - protein, 137 aa, Homo sapiens
  Payload ID: 13868
  Gene Symbol: PRPF40B
  Gene Name: PRP40 homolog, pre-mRNA processing factor B
  ENSP ID: ENSP00000449485
LKDRGFCVEVNTAFEDFAHVISFDKRAAALDAGNIKLTFNSLLEKAEAREREREKEEARRMRRREAAFRSMLRQAVPALELGTAWEEVRERFVCDSAFEQITLESERIRLFREFLQVLETECQHLHTKGRKHGRKGL

SEQ ID NO: 69815 - protein, 6 aa, Homo sapiens
  Payload ID: 13868
  Gene Symbol: PRPF40B
  Gene Name: PRP40 homolog, pre-mRNA processing factor B
  ENSP ID: ENSP00000449569
MMPPPF

SEQ ID NO: 69816 - protein, 109 aa, Homo sapiens
  Payload ID: 13869
  Gene Symbol: PRPF40A
  Gene Name: PRP40 pre-mRNA processing factor 40 homolog A
  ENSP ID: ENSP00000346332
  MOD_RES (1)..(1): Any amino acid
XLRSLLVGMCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPLN

SEQ ID NO: 69817 - protein, 930 aa, Homo sapiens
  Payload ID: 13869
  Gene Symbol: PRPF40A
  Gene Name: PRP40 pre-mRNA processing factor 40 homolog A
  Uniprot ID: O75400
  ENSP ID: ENSP00000386458
MCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEGYQNTIVAGSLITKSNLHAMIKAEESSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVADFTPKKEEEESQPAKKTYTWNTKEEAKQAFKELLKEKRVPSNASWEQAMKMIINDPRYSALAKLSEKKQAFNAYKVQTEKEEKEEARSKYKEAKESFQRFLENHEKMTSTTRYKKAEQMFGEMEVWNAISERDRLEIYEDVLFFLSKKEKEQAKQLRKRNWEALKNILDNMANVTYSTTWSEAQQYLMDNPTFAEDEELQNMDKEDALICFEEHIRALEKEEEEEKQKSLLRERRRQRKNRESFQIFLDELHEHGQLHSMSSWMELYPTISSDIRFTNMLGQPGSTALDLFKFYVEDLKARYHDEKKIIKDILKDKGFVVEVNTTFEDFVAIISSTKRSTTLDAGNIKLAFNSLLEKAEAREREREKEEARKMKRKESAFKSMLKQAAPPIELDAVWEDIRERFVKEPAFEDITLESERKRIFKDFMHVLEHECQHHHSKNKKHSKKSKKHHRKRSRSRSGSDSDDDDSHSKKKRQRSESRSASEHSSSAESERSYKKSKKHKKKSKKRRHKSDSPESDAEREKDKKEKDRESEKDRTRQRSESKHKSPKKKTGKDSGNWDTSGSELSEGELEKRRRTLLEQLDDDQ

SEQ ID NO: 69818 - protein, 163 aa, Homo sapiens
  Payload ID: 13869
  Gene Symbol: PRPF40A
  Gene Name: PRP40 pre-mRNA processing factor 40 homolog A
  ENSP ID: ENSP00000406924
RSLLVGMCSGSGRRRSSLSPTMRPGTGAERGGLMMGHPGMHYAPMGMHPMGQRANMPPVPHGMMPQMMPPMGGPPMGQMPGMMSSVMPGMMMSHMSQASMQPALPQLLSKCPWKEYKSDSGKPYYYNSQTKESRWAKPKELEDLEGYQNTIVAGSLITKSNLH

SEQ ID NO: 69819 - protein, 346 aa, Homo sapiens
  Payload ID: 13869
  Gene Symbol: PRPF40A
  Gene Name: PRP40 pre-mRNA processing factor 40 homolog A
  ENSP ID: ENSP00000441656
ERGGLMVSEMESHPPSQGPGDGERRLSGSSLCSGSWVSADGFLRRRPSMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEAMIKAEESSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVAE

SEQ ID NO: 69820 - protein, 448 aa, Homo sapiens
  Payload ID: 13869
  Gene Symbol: PRPF40A
  Gene Name: PRP40 pre-mRNA processing factor 40 homolog A
  ENSP ID: ENSP00000444656
MRPGTGAERGGLMVSEMESHPPSQGPGDGERRLSGSSLCSGSWVSADGFLRRRPSMGHPGMHYAPMGMHPMGQRANMPPVPHGMMPQMMPPMGGPPMGQMPGMMSSVMPGMMMSHMSQASMQPALPPGVNSMDVAAGTASGAKSMWTEHKSPDGRTYYYNTETKQSTWEKPDDLKTPAEQLLSKCPWKEYKSDSGKPYYYNSQTKESRWAKPKELEDLEGYQNTIVAGSLITKSNLHAMIKAEESSKQEECTTTSTAPVPTTEIPTTMSTMAAAEAAAAVVAAAAAAAAAAAAANANASTSASNTVSGTVPVVPEPEVTSIVATVVDNENTVTISTEEQAQLTSTPAIQDQSVEVSSNTGEETSKQETVADFTPKKEEEESQPAKKTYTWNTKEEAKQAFKELLKEKRVPSNASWEQAMKMIINDPRYSALAKLSEKKQAFNAYKVQT

SEQ ID NO: 69821 - protein, 643 aa, Homo sapiens
  Payload ID: 13870
  Gene Symbol: PRR5-ARHGAP8
  Gene Name: PRR5-ARHGAP8 readthrough
  ENSP ID: ENSP00000262731
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILELQRDKAAAAAVLGAVRKRPSVVPMAGQDPALSTSHPFYDVARHGILQVAGDDRFGRRVVTFSCCRMPPSHELDHQRLLEYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 69822 - protein, 564 aa, Homo sapiens
  Payload ID: 13870
  Gene Symbol: PRR5-ARHGAP8
  Gene Name: PRR5-ARHGAP8 readthrough
  ENSP ID: ENSP00000354732
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 69823 - protein, 504 aa, Homo sapiens
  Payload ID: 13870
  Gene Symbol: PRR5-ARHGAP8
  Gene Name: PRR5-ARHGAP8 readthrough
  ENSP ID: ENSP00000425026
  MOD_RES (1)..(1): Any amino acid
XLGSFFTEYLQNQLLTKGMVILRDKIRFYEELQRDKAAAAAVLGAVRKRPSVVPMAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITSLPLAPLELSREPHALPGVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 69824 - protein, 453 aa, Homo sapiens
  Payload ID: 13871
  Gene Symbol: PRUNE
  Gene Name: prune exopolyphosphatase
  Uniprot ID: Q86TP1
  ENSP ID: ENSP00000271620
MEDYLQGCRAALQESRPLHVVLGNEACDLDSTVSALALAFYLAKTTEAEEVFVPVLNIKRSELPLRGDIVFFLQKVHIPESILIFRDEIDLHALYQAGQLTLILVDHHILSKSDTALEEAVAEVLDHRPIEPKHCPPCHVSVELVGSCATLVTERILQGAPEILDRQTAALLHGTIILDCVNMDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 69825 - protein, 218 aa, Homo sapiens
  Payload ID: 13871
  Gene Symbol: PRUNE
  Gene Name: prune exopolyphosphatase
  Uniprot ID: Q86TP1
  ENSP ID: ENSP00000357930
MDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 69826 - protein, 168 aa, Homo sapiens
  Payload ID: 13871
  Gene Symbol: PRUNE
  Gene Name: prune exopolyphosphatase
  Uniprot ID: Q86TP1
  ENSP ID: ENSP00000357931
MLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 69827 - protein, 271 aa, Homo sapiens
  Payload ID: 13871
  Gene Symbol: PRUNE
  Gene Name: prune exopolyphosphatase
  Uniprot ID: Q86TP1
  ENSP ID: ENSP00000357932
MDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMNSLVDECPLDQGLPKLSAEAVFEKCSQISLSQSTTASLSKK

SEQ ID NO: 69828 - protein, 218 aa, Homo sapiens; identical to SEQ ID NO: 69825
  Payload ID: 13871
  Gene Symbol: PRUNE
  Gene Name: prune exopolyphosphatase
  Uniprot ID: Q86TP1
  ENSP ID: ENSP00000357933

SEQ ID NO: 69829 - protein, 139 aa, Homo sapiens
  Payload ID: 13871
  Gene Symbol: PRUNE
  Gene Name: prune exopolyphosphatase
  ENSP ID: ENSP00000387696
MDLKIGKATPKDSKYVEKLEALFPDLPKRNDIFDSLQKAKFDVSGLTTEQMLRKDQKTIYRQGVKVAISAIYMDLEAFLQRSNLLADLHAFCQAHSYDVLVAMTIFFNTHNEPVRQLAIFCPHVALQTTICEVLERSHS

SEQ ID NO: 69830 - protein, 178 aa, Homo sapiens
  Payload ID: 13871
  Gene Symbol: PRUNE
  Gene Name: prune exopolyphosphatase
  ENSP ID: ENSP00000392632
MDLKIGKATPKDSKYVEKLEALFPDLPKRNDIFDSLQKAKFDVSGLTTEQMLRKDQKTIYRQGVKVAISAIYMDLEICEVLERSHSPPLKLTPASSTHPNLHAYLQGNTQVSRKKLLPLLQEALSAYFDSMKIPSGQPETADVSREQVDKELDRASNSLISGLSQDEEDPPLPPTPMN

SEQ ID NO: 69831 - protein, 191 aa, Homo sapiens [sequence omitted]

SEQ ID NO: 69832 - protein, 298 aa, Homo sapiens
  Payload ID: 13872
  Gene Symbol: PRUNE2
  Gene Name: prune homolog 2 (Drosophila)
  ENSP ID: ENSP00000365903
MEEFLQRAKSKLNRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQGLSIEQTMLKDLKELSDGEIKVAISTVSMNLEMSRIELFPKGTWLVNRDAFQSRNSGSKCMPGTTVLQCTLRSLQRGK

SEQ ID NO: 69833 - protein, 353 aa, Homo sapiens
  Payload ID: 13872
  Gene Symbol: PRUNE2
  Gene Name: prune homolog 2 (Drosophila)
  ENSP ID: ENSP00000365907
MLKSCSRASFSPSVRKPPLILRRLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 69834 - protein, 3088 aa, Homo sapiens
  Payload ID: 13872
  Gene Symbol: PRUNE2
  Gene Name: prune homolog 2 (Drosophila)
  Uniprot ID: Q8WUY3
  ENSP ID: ENSP00000365908
MEEFLQRAKSKLNRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQGLSIEQTMLKDLKELSDGEIKVAISTVSMNLENCLFHSNITSDLKAFTDKFGFDVLILFSSYLSEEQQPRRQIAVYSENMELCSQICCELEECQNPCLELEPFDCGCDEILVYQQEDPSVTCDQVVLVVKEVINRRCPEMVSNSRTSSTEAVAGSAPLSQGSSGIMELYGSDIEPQPSSVNFIENPPDLNDSNQAQVDANVDLVSPDSGLATIRSSRSSKESSVFLSDDSPVGEGAGPHHTLLPGLDSYSPIPEGAVAEEHAWSGEHGEHFDLFNFDPAPMASGQSQQSSHSADYSPADDFFPNSDLSEGQLPAGPEGLDGMGTNMSNYSSSSLLSGAGKDSLVEHDEEFVQRQDSPRDNSERNLSLTDFVGDESPSPERLKNTGKRIPPTPMNSLVESSPSTEEPASLYTEDMTQKATDTGHMGPPQTHARCSSWWGGLEIDSKNIADAWSSSEQESVFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 69835 - protein, 2384 aa, Homo sapiens
  Payload ID: 13872
  Gene Symbol: PRUNE2
  Gene Name: prune homolog 2 (Drosophila)
  ENSP ID: ENSP00000389706
  MOD_RES (1)..(1): Any amino acid
XFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHDPTANKDSGQESESIPEYTAEEEREDNRLWRTVVIGEQEQRIDMKVIEPYRRVISHGGDSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIINIDLKLKEKP

SEQ ID NO: 69836 - protein, 260 aa, Homo sapiens
  Payload ID: 13872
  Gene Symbol: PRUNE2
  Gene Name: prune homolog 2 (Drosophila)
  ENSP ID: ENSP00000393657
IDINVDELDTPDEADSFEYTGHDPTANKDSGQESESIPEYTAEEEREDNRLWRTVVIGEQEQRIDMKVIEPYRRVISHGGDSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKYDEERSYKRSVRTSCLYNDPEMSSMEKDIDLKLKEKP

SEQ ID NO: 69837 - protein, 3062 aa, Homo sapiens
  Payload ID: 13872
  Gene Symbol: PRUNE2
  Gene Name: prune homolog 2 (Drosophila)
  ENSP ID: ENSP00000393843
MEEFLQRAKSKLNRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQGLSIEQTMLKDLKELSDGEIKVAISTVSMNLENCLFHSNITSDLKAFTDKFGFDVLILFSSYLSEEQQPRRQIAVYSENMELCSQICCELEECQNPCLELEPFDCGCDEILVYQQEDPSVTCDQVVLVVKEVINRRCPEMVSNSRTSSTEAVAGSAPLSQGSSGIMELYGSDIEPQPSSVNFIENPPDLNDSNQAQVDANVDLVSPDSGLATIRSSRSSKESSVFLSDDSPVGEGAGPHHTLLPGLDSYSPIPEGAVAEEHAWSGEHGEHFDLFNFDPAPMASGQSQQSSHSADYSPADDFFPNSDLSEGQLPAGPEGLDGMGTNMSNYSSSSLLSGAGKDSLVEHDEEFVQRQDSPRDNSERNLSLTDFVGDESPSPERLKNTGKRIPPTPMNSLVESSPSTEEPASLYTEDMTQKATDTGHMGPPQTHARCSSWWGGLEIDSKNIADAWSSSEQESVFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHDPTANKDSGQESESIPEYTAEEEREDNRLWRTVVIGEQEQRIDMKVIEPYRRVISHGGDSGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIINIDLKLKEKP

SEQ ID NO: 69838 - protein, 2730 aa, Homo sapiens
  Payload ID: 13872
  Gene Symbol: PRUNE2
  Gene Name: prune homolog 2 (Drosophila)
  ENSP ID: ENSP00000397425
MVSNSRTSSTEAVAGSAPLSQGSSGIMELYGSDIEPQPSSVNFIENPPDLNDSNQAQVDANVDLVSPDSGLATIRSSRSSKESSVFLSDDSPVGEGAGPHHTLLPGLDSYSPIPEGAVAEEHAWSGEHGEHFDLFNFDPAPMASGQSQQSSHSADYSPADDFFPNSDLSEGQLPAGPEGLDGMGTNMSNYSSSSLLSGAGKDSLVEHDEEFVQRQDSPRDNSERNLSLTDFVGDESPSPERLKNTGKRIPPTPMNSLVESSPSTEEPASLYTEDMTQKATDTGHMGPPQTHARCSSWWGGLEIDSKNIADAWSSSEQESVFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHEDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 69839 - protein, 1746 aa, Homo sapiens
  Payload ID: 13873
  Gene Symbol: PEAK1
  Gene Name: pseudopodium-enriched atypical kinase 1
  Uniprot ID: Q9H792
  ENSP ID: ENSP00000309230
MSACNTFTEHVWKPGECKNCFKPKSLHQLPPDPEKAPITHGNVKTNANHSNNHRIRNTGNFRPPVAKKPTIAVKPTMIVADGQSICGELSIQEHCENKPVIIGWNRNRAALSQKPLNNNNEDDEGISHVPKPYGNNDSAKKMSDNNNGLTEVLKEIAGLDTAPQIRGNETNSRETFLGRINDCYKRSLERKLPPSCMIGGIKETQGKHVILSGSTEVISNEGGRFCYPEFSSGEESEEDVLFSNMEEEHESWDESDEELLAMEIRMRGQPRFANFRANTLSPVRFFVDKKWNTIPLRNKSLQRICAVDYDDSYDEILNGYEENSVVSYGQGSIQSMVSSDSTSPDSSLTEESRSETASSLSQKICNGGLSPGNPGDSKDMKEIEPNYESPSSNNQDKDSSQASKSSIKVPETHKAVLALRLEEKDGKIAVQTEKEESKASTDVAGQAVTINLVPTEEQAKPYRVVNLEQPLCKPYTVVDVSAAMASEHLEGPVNSPKTKSSSSTPNSPVTSSSLTPGQISAHFQKSSAIRYQEVWTSSTSPRQKIPKVELITSGTGPNVPPRKNCHKSAPTSPTATNISSKTIPVKSPNLSEIKFNSYNNAGMPPFPIIIHDEPTYARSSKNAIKVPIVINPNAYDNLAIYKSFLGTSGELSVKEKTTSVISHTYEEIETESKVPDNTTSKTTDCLQTKGFSNSTEHKRGSVAQKVQEFNNCLNRGQSSPQRSYSSSHSSPAKIQRATQEPVAKIEGTQESQMVGSSSTREKASTVLSQIVASIQPPQSPPETPQSGPKACSVEELYAIPPDADVAKSTPKSTPVRPKSLFTSQPSGEAEAPQTTDSPTTKVQKDPSIKPVTPSPSKLVTSPQSEPPAPFPPPRSTSSPYHAGNLLQRHFTNWTKPTSPTRSTEAESVLHSEGSRRAADAKPKRWISFKSFFRRRKTDEEDDKEKEREKGKLVGLDGTVIHMLPPPPVQRHHWFTEAKGESSEKPAIVFMYRCDPAQGQLSVDQSKARTDQAAVMEKGRAENALLQDSEKKRSHSSPSQIPKKILSHMTHEVTEDFSPRDPRTVVGKQDGRGCTSVTTALSLPELEREDGKEDISDPMDPNPCSATYSNLGQSRAAMIPPKQPRQPKGAVDDAIAFGGKTDQEAPNASQPTPPPLPKKMIIRANTEPISKDLQKSMESSLCVMANPTYDIDPNWDASSAGSSISYELKGLDIESYDSLERPLRKERPVPSAANSISSLTTLSIKDRFSNSMESLSSRRGPSCRQGRGIQKPQRQALYRGLENREEVVGKIRSLHTDALKKLAVKCEDLFMAGQKDQLRFGVDSWSDFRLTSDKPCCEAGDAVYYTASYAKDPLNNYAVKICKSKAKESQQYYHSLAVRQSLAVHFNIQQDCGHFLAEVPNRLLPWEDPDDPEKDEDDMEETEEDAKGETDGKNPKPCSEAASSQKENQGVMSKKQRSHVVVITREVPCLTVADFVRDSLAQHGKSPDLYERQVCLLLLQLCSGLEHLKPYHVTHCDLRLENLLLVHYQPGGTAQGFGPAEPSPTSSYPTRLIVSNFSQAKQKSHLVDPEILRDQSRLAPEIITATQYKKCDEFQTGILIYEMLHLPNPFDENPELKEREYTRADLPRIPFRSPYSRGLQQLASCLLNPNPSERILISDAKGILQCLLWGPREDLFQTFTACPSLVQRNTLLQNWLDIKRTLLMIKFAEKSLDREGGISLEDWLCAQYLAFATTDSLSCIVKILQHR

SEQ ID NO: 69840 - protein, 1746 aa, Homo sapiens; identical to SEQ ID NO: 69839
  Payload ID: 13873
  Gene Symbol: PEAK1
  Gene Name: pseudopodium-enriched atypical kinase 1
  Uniprot ID: Q9H792
  ENSP ID: ENSP00000452796

SEQ ID NO: 69841 - protein, 1049 aa, Homo sapiens
  Payload ID: 13873
  Gene Symbol: PEAK1
  Gene Name: pseudopodium-enriched atypical kinase 1
  ENSP ID: ENSP00000453924
MSACNTFTEHVWKPGECKNCFKPKSLHQLPPDPEKAPITHGNVKTNANHSNNHRIRNTGNFRPPVAKKPTIAVKPTMIVADGQSICGELSIQEHCENKPVIIGWNRNRAALSQKPLNNNNEDDEGISHVPKPYGNNDSAKKMSDNNNGLTEVLKEIAGLDTAPQIRGNETNSRETFLGRINDCYKRSLERKLPPSCMIGGIKETQGKHVILSGSTEVISNEGGRFCYPEFSSGEESEEDVLFSNMEEEHESWDESDEELLAMEIRMRGQPRFANFRANTLSPVRFFVDKKWNTIPLRNKSLQRICAVDYDDSYDEILNGYEENSVVSYGQGSIQSMVSSDSTSPDSSLTEESRSETASSLSQKICNGGLSPGNPGDSKDMKEIEPNYESPSSNNQDKDSSQASKSSIKVPETHKAVLALRLEEKDGKIAVQTEKEESKASTDVAGQAVTINLVPTEEQAKPYRVVNLEQPLCKPYTVVDVSAAMASEHLEGPVNSPKTKSSSSTPNSPVTSSSLTPGQISAHFQKSSAIRYQEVWTSSTSPRQKIPKVELITSGTGPNVPPRKNCHKSAPTSPTATNISSKTIPVKSPNLSEIKFNSYNNAGMPPFPIIIHDEPTYARSSKNAIKVPIVINPNAYDNLAIYKSFLGTSGELSVKEKTTSVISHTYEEIETESKVPDNTTSKTTDCLQTKGFSNSTEHKRGSVAQKVQEFNNCLNRGQSSPQRSYSSSHSSPAKIQRATQEPVAKIEGTQESQMVGSSSTREKASTVLSQIVASIQPPQSPPETPQSGPKACSVEELYAIPPDADVAKSTPKSTPVRPKSLFTSQPSGEAEAPQTTDSPTTKVQKDPSIKPVTPSPSKLVTSPQSEPPAPFPPPRSTSSPYHAGNLLQRHFTNWTKPTSPTRSTEAESVLHSEGSRRAADAKPKRWISFKSFFRRRKTDEEDDKEKEREKGKLVGLDGTVIHMLPPPPVQRHHWFTEAKGESSEKPAIVFMYRCDPAQGQLSVDQSKARTDQAAVMEKGRAENALLQDSEKKRSHSSPSQIPKKILRYVK

SEQ ID NO: 69842 - protein, 60 aa, Homo sapiens
  Payload ID: 13873
  Gene Symbol: PEAK1
  Gene Name: pseudopodium-enriched atypical kinase 1
  ENSP ID: ENSP00000457602
MSACNTFTEHVWKPGECKNCFKPKSLHQLPPDPEKAPITHGNVKTNANHSNNHRIRNTGN

SEQ ID NO: 69843 - protein, 656 aa, Homo sapiens
  Payload ID: 13873
  Gene Symbol: PEAK1
  Gene Name: pseudopodium-enriched atypical kinase 1
  ENSP ID: ENSP00000457880
MSACNTFTEHVWKPGECKNCFKPKSLHQLPPDPEKAPITHGNVKTNANHSNNHRIRNTGNFRPPVAKKPTIAVKPTMIVADGQSICGELSIQEHCENKPVIIGWNRNRAALSQKPLNNNNEDDEGISHVPKPYGNNDSAKKMSDNNNGLTEVLKEIAGLDTAPQIRGNETNSRETFLGRINDCYKRSLERKLPPSCMIGGIKETQGKHVILSGSTEVISNEGGRFCYPEFSSGEESEEDVLFSNMEEEHESWDESDEELLAMEIRMRGQPRFANFRANTLSPVRFFVDKKWNTIPLRNKSLQRICAVDYDDSYDEILNGYEENSVVSYGQGSIQSMVSSDSTSPDSSLTEESRSETASSLSQKICNGGLSPGNPGDSKDMKEIEPNYESPSSNNQDKDSSQASKSSIKVPETHKAVLALRLEEKDGKIAVQTEKEESKASTDVAGQAVTINLVPTEEQAKPYRVVNLEQPLCKPYTVVDVSAAMASEHLEGPVNSPKTKSSSSTPNSPVTSSSLTPGQISAHFQKSSAIRYQEVWTSSTSPRQKIPKVELITSGTGPNVPPRKNCHKSAPTSPTATNISSKTIPVKSPNLSEIKFNSYNNAGMPPFPIIIHDEPTYARSSKNAIKVPIVINPNAYDNLAIYKSFLGTSGELSVKEK

SEQ ID NO: 69844 - protein, 228 aa, Homo sapiens
  Payload ID: 13874
  Gene Symbol: PUDP
  Gene Name: pseudouridine 5'-phosphatase
  Uniprot ID: Q08623
  ENSP ID: ENSP00000370467
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 69845 - protein, 251 aa, Homo sapiens
  Payload ID: 13874
  Gene Symbol: PUDP
  Gene Name: pseudouridine 5'-phosphatase
  Uniprot ID: Q08623
  ENSP ID: ENSP00000396452
MAAPPQPVTHLIFDMDGLLLGYTGSIVAAASGESSRGLQSRWTDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 69846 - protein, 185 aa, Homo sapiens
  Payload ID: 13874
  Gene Symbol: PUDP
  Gene Name: pseudouridine 5'-phosphatase
  Uniprot ID: Q08623
  ENSP ID: ENSP00000406260
MAAPPQPVTHLIFDMDGLLLDTERLYSVVFQEICNRYDKKYSWDVKSLVMGAEKLIIHLRKHGIPFALATSSGSASFDMKTSRHKEFFSLFSHIVLGDDPEVQHGKPDPDIFLACAKRFSPPPAMEKCLVFEDAPNGVEAALAAGMQVVMVPDGNLSRDLTTKATLVLNSLQDFQPELFGLPSYE

SEQ ID NO: 69847 - protein, 191 aa, Homo sapiens
  Payload ID: 13874
  Gene Symbol: PUDP
  Gene Name: pseudouridine 5'-phosphatase
  ENSP ID: ENSP00000430995
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKSSIHRPRLLTAQKCQGCRDPF

SEQ ID NO: 69848 - protein, 208 aa, Homo sapiens
  Payload ID: 13874
  Gene Symbol: PUDP
  Gene Name: pseudouridine 5'-phosphatase
  Uniprot ID: Q08623
  ENSP ID: ENSP00000441208
MAAPPQPVTHLIFDMDGLLLDTERLYSVVFQEICNRYDKKYSWDVKSLVMGKKALEAAQIIIDVLQLPMSKEELVEESQTKLKEVFPTAALMPGAEKLIIHLRKHGIPFALATSSGSASFDMKTSRHKEFFSLFSHIVLGDDPEVQHGKPDPDIFLACAKRFSPPPAMEKSSIHRPRLLTAQKCQGCRDPFSALLLLCNQLLLCSDDT

SEQ ID NO: 69849 - protein, 384 aa, Homo sapiens
  Payload ID: 13875
  Gene Symbol: PUS1
  Gene Name: pseudouridylate synthase 1
  ENSP ID: ENSP00000324726
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAK

SEQ ID NO: 69850 - protein, 427 aa, Homo sapiens
  Payload ID: 13875
  Gene Symbol: PUS1
  Gene Name: pseudouridylate synthase 1
  Uniprot ID: Q9Y606
  ENSP ID: ENSP00000365837
MGLQLRALLGAFGRWTLRLGPRPSCSPRMAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 69851 - protein, 399 aa, Homo sapiens
  Payload ID: 13875
  Gene Symbol: PUS1
  Gene Name: pseudouridylate synthase 1
  Uniprot ID: Q9Y606
  ENSP ID: ENSP00000392451
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 69852 - protein, 156 aa, Homo sapiens
  Payload ID: 13875
  Gene Symbol: PUS1
  Gene Name: pseudouridylate synthase 1
  ENSP ID: ENSP00000409705
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKSQDLILLPRLECSGMIMAHCSLKLLGSSNPPASASRV

SEQ ID NO: 69853 - protein, 374 aa, Homo sapiens
  Payload ID: 13875
  Gene Symbol: PUS1
  Gene Name: pseudouridylate synthase 1
  ENSP ID: ENSP00000438948
MSVAAHTCNLSTSGGQRSKRPGVRDQPGQHHGDLCLQNIKSVFVSFFQRNVGSSQFKTIEDDLVSALVRSGCIPENHGEDMRKMSFQRCARTDKGVSAAGQVVSLKVWLIDDILEKINSHLPSHIRILGLKRVTGGFNSKNRCDARTYCYLLPTFAFAHKDRDVQDETYRLSAETLQQVNRLLACYKGTHNFHNFTSQKGPQDPSACRYILEMYCEEPFVREGLEFAVIRVKGQSFMMHQIRKMVGLVVAIVKGYAPESVLERSWGTEKVDVPKAPGLGLVLERVHFEKYNQRFGNDGLHEPLDWAQEEGKVAAFKEEHIYPTIIGTERDERSMAQWLSTLPIHNFSATALTAGGTGAKVPSPLEGSEGDGDTD

SEQ ID NO: 69854 - protein, 200 aa, Homo sapiens
  Payload ID: 13875
  Gene Symbol: PUS1
  Gene Name: pseudouridylate synthase 1
  ENSP ID: ENSP00000440179
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKSQDLILLPRLECSGMIMAHCSLKLLGSSNPPASASRVGLKRVTGGFNSKNRCDARTYCYLLPTFAFAHKDRDVQDETYRLS

SEQ ID NO: 69855 - protein, 153 aa, Homo sapiens
  Payload ID: 13875
  Gene Symbol: PUS1
  Gene Name: pseudouridylate synthase 1
  ENSP ID: ENSP00000440326
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKGVSAAGQVVSLKVWLIDDILEKINSHLPSHIRIL

SEQ ID NO: 69856 - protein, 134 aa, Homo sapiens
  Payload ID: 13875
  Gene Symbol: PUS1
  Gene Name: pseudouridylate synthase 1
  ENSP ID: ENSP00000443969
MAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKVPSPLEGSEGDGDTD

SEQ ID NO: 69857 - protein, 184 aa, Homo sapiens
  Payload ID: 13875
  Gene Symbol: PUS1
  Gene Name: pseudouridylate synthase 1
  ENSP ID: ENSP00000445819
MGLQLRALLGAFGRWTLRLGPRPSCSPRMAGNAEPPPAGAACPQDRRSCSGRAGGDRVWEDGEHPAKKLKSGGDEERREKPPKRKIVLLMAYSGKGYHGMQRNVGSSQFKTIEDDLVSALVRSGCIPENHGEDMRKMSFQRCARTDKSQDLILLPRLECSGMIMAHCSLKLLGSSNPPASASRV

SEQ ID NO: 69858 - protein, 529 aa, Homo sapiens
  Payload ID: 13876
  Gene Symbol: PUS10
  Gene Name: pseudouridylate synthase 10
  Uniprot ID: Q3MIT2
  ENSP ID: ENSP00000326003
MFPLTEENKHVAQLLLNTGTCPRCIFRFCGVDFHAPYKLPYKELLNELQKFLETEKDELILEVMNPPPKKIRLQELEDSIDNLSQNGEGRISVSHVGSTASKNSNLNVCNVCLGILQEFCEKDFIKKVCQKVEASGFEFTSLVFSVSFPPQLSVREHAAWLLVKQEMGKQSLSLGRDDIVQLKEAYKWITHPLFSEELGVPIDGKSLFEVSVVFAHPETVEDCHFLAAICPDCFKPAKNKQSVFTRMAVMKALNKIKEEDFLKQFPCPPNSPKAVCAVLEIECAHGAVFVAGRYNKYSRNLPQTPWIIDGERKLESSVEELISDHLLAVFKAESFNFSSSGREDVDVRTLGNGRPFAIELVNPHRVHFTSQEIKELQQKINNSSNKIQVRDLQLVTREAIGHMKEGEEEKTKTYSALIWTNKAIQKKDIEFLNDIKDLKIDQKTPLRVLHRRPLAVRARVIHFMETQYVDEHHFRLHLKTQAGTYIKEFVHGDFGRTKPNIGSLMNVTADILELDVESVDVDWPPALDD

SEQ ID NO: 69859 - protein, 62 aa, Homo sapiens
  Payload ID: 13876
  Gene Symbol: PUS10
  Gene Name: pseudouridylate synthase 10
  ENSP ID: ENSP00000381651
MFPLTEENKHVAQLLLNTGTCPRCIFRFCGVDFHAPYKLPYKMKKLRYREVKQPAQSYTAIK

SEQ ID NO: 69860 - protein, 529 aa, Homo sapiens; identical to SEQ ID NO: 69858
  Payload ID: 13876
  Gene Symbol: PUS10
  Gene Name: pseudouridylate synthase 10
  Uniprot ID: Q3MIT2
  ENSP ID: ENSP00000386074

SEQ ID NO: 69861 - protein, 120 aa, Homo sapiens
  Payload ID: 13876
  Gene Symbol: PUS10
  Gene Name: pseudouridylate synthase 10
  ENSP ID: ENSP00000402185
MFPLTEENKHVAQLLLNTGTCPRCIFRFCGVDFHAPYKLPYKELLNELQKFLETEKDELILEVMNPPPKKIRLQELEDSIDNLSQNGEGRISVSHVGSTASKNSNLNVCNVCLGILQEFC

SEQ ID NO: 69862 - protein, 62 aa, Homo sapiens; identical to SEQ ID NO: 69859
  Payload ID: 13876
  Gene Symbol: PUS10
  Gene Name: pseudouridylate synthase 10
  ENSP ID: ENSP00000403880

SEQ ID NO: 69863 - protein, 481 aa, Homo sapiens
  Payload ID: 13877
  Gene Symbol: PUS3
  Gene Name: pseudouridylate synthase 3
  Uniprot ID: Q9BZE2
  ENSP ID: ENSP00000227474
MAYNDTDRNQTEKLLKRVRELEQEVQRLKKEQAKNKEDSNIRENSAGAGKTKRAFDFSAHGRRHVALRIAYMGWGYQGFASQENTNNTIEEKLFEALTKTRLVESRQTSNYHRCGRTDKGVSAFGQVISLDLRSQFPRGRDSEDFNVKEEANAAAEEIRYTHILNRVLPPDIRILAWAPVEPSFSARFSCLERTYRYFFPRADLDIVTMDYAAQKYVGTHDFRNLCKMDVANGVINFQRTILSAQVQLVGQSPGEGRWQEPFQLCQFEVTGQAFLYHQVRCMMAILFLIGQGMEKPEIIDELLNIEKNPQKPQYSMAVEFPLVLYDCKFENVKWIYDQEAQEFNITHLQQLWANHAVKTHMLYSMLQGLDTVPVPCGIGPKMDGMTEWGNVKPSVIKQTSAFVEGVKMRTYKPLMDRPKCQGLESRIQHFVRRGRIEHPHLFHEEETKAKRDCNDTLEEENTNLETPTKRVCVDTEIKSII

SEQ ID NO: 69864 - protein, 169 aa, Homo sapiens
  Payload ID: 13877
  Gene Symbol: PUS3
  Gene Name: pseudouridylate synthase 3
  ENSP ID: ENSP00000432272
MAYNDTDRNQTEKLLKRVRELEQEVQRLKKEQAKNKEDSNIRENSAGAGKTKRAFDFSAHGRRHVALRIAYMGWGYQGFASQENTNNTIEEKLFEALTKTRLVESRQTSNYHRCGRTDKGVSAFGQVISLDLRSQFPRGRDSEDFNVKEEANAAAEEIRYTHILNRVLP

SEQ ID NO: 69865 - protein, 481 aa, Homo sapiens; identical to SEQ ID NO: 69863
  Payload ID: 13877
  Gene Symbol: PUS3
  Gene Name: pseudouridylate synthase 3
  Uniprot ID: Q9BZE2
  ENSP ID: ENSP00000432386

SEQ ID NO: 69866 - protein, 105 aa, Homo sapiens
  Payload ID: 13877
  Gene Symbol: PUS3
  Gene Name: pseudouridylate synthase 3
  ENSP ID: ENSP00000437077
MAYNDTDRNQTEKLLKRVRELEQEVQRLKKEQAKNKEDSNIRENSAGAGKTKRAFDFSAHGRRHVALRIAYMGWGYQGFASQENTNNTIEEKLFEALTKTRLVES

SEQ ID NO: 69867 - protein, 273 aa, Homo sapiens
  Payload ID: 13877
  Gene Symbol: PUS3
  Gene Name: pseudouridylate synthase 3
  ENSP ID: ENSP00000481536
MDYAAQKYVGTHDFRNLCKMDVANGVINFQRTILSAQVQLVGQSPGEGRWQEPFQLCQFEVTGQAFLYHQVRCMMAILFLIGQGMEKPEIIDELLNIEKNPQKPQYSMAVEFPLVLYDCKFENVKWIYDQEAQEFNITHLQQLWANHAVKTHMLYSMLQGLDTVPVPCGIGPKMDGMTEWGNVKPSVIKQTSAFVEGVKMRTYKPLMDRPKCQGLESRIQHFVRRGRIEHPHLFHEEETKAKRDCNDTLEEENTNLETPTKRVCVDTEIKSII

SEQ ID NO: 69868 - protein, 661 aa, Homo sapiens
  Payload ID: 13878
  Gene Symbol: PUS7
  Gene Name: pseudouridylate synthase 7 (putative)
  Uniprot ID: Q96PZ0
  ENSP ID: ENSP00000348722
MEMTEMTGVSLKRGALVVEDNDSGVPVEETKKQKLSECSLTKGQDGLQNDFLSISEDVPRPPDTVSTGKGGKNSEAQLEDEEEEEEDGLSEECEEEESESFADMMKHGLTEADVGITKFVSSHQGFSGILKERYSDFVVHEIGKDGRISHLNDLSIPVDEEDPSEDIFTVLTAEEKQRLEELQLFKNKETSVAIEVIEDTKEKRTIIHQAIKSLFPGLETKTEDREGKKYIVAYHAAGKKALANPRKHSWPKSRGSYCHFVLYKENKDTMDAINVLSKYLRVKPNIFSYMGTKDKRAITVQEIAVLKITAQRLAHLNKCLMNFKLGNFSYQKNPLKLGELQGNHFTVVLRNITGTDDQVQQAMNSLKEIGFINYYGMQRFGTTAVPTYQVGRAILQNSWTEVMDLILKPRSGAEKGYLVKCREEWAKTKDPTAALRKLPVKRCVEGQLLRGLSKYGMKNIVSAFGIIPRNNRLMYIHSYQSYVWNNMVSKRIEDYGLKPVPGDLVLKGATATYIEEDDVNNYSIHDVVMPLPGFDVIYPKHKIQEAYREMLTADNLDIDNMRHKIRDYSLSGAYRKIIIRPQNVSWEVVAYDDPKIPLFNTDVDNLEGKTPPVFASEGKYRALKMDFSLPPSTYATMAIREVLKMDTSIKNQTQLNTTWLR

SEQ ID NO: 69869 - protein, 661 aa, Homo sapiens; identical to SEQ ID NO: 69868
  Payload ID: 13878
  Gene Symbol: PUS7
  Gene Name: pseudouridylate synthase 7 (putative)
  Uniprot ID: Q96PZ0
  ENSP ID: ENSP00000417402

SEQ ID NO: 69870 - protein, 132 aa, Homo sapiens
  Payload ID: 13878
  Gene Symbol: PUS7
  Gene Name: pseudouridylate synthase 7 (putative)
  ENSP ID: ENSP00000417718
  MOD_RES (1)..(1): Any amino acid
XSGILKERYSDFVVHEIGKDGRISHLNDLSIPVDEEVIEDTKEKRTIIHQAIKSLFPGLETKTEDREGKKYIVAYHAAGKKALANPRKHSWPKSRGSYCHFVLYKENKDTMDAINVLSKYLRVKPNIFSYMG

SEQ ID NO: 69871 - protein, 448 aa, Homo sapiens
  Payload ID: 13878
  Gene Symbol: PUS7
  Gene Name: pseudouridylate synthase 7 (putative)
  ENSP ID: ENSP00000418794
MEMTEMTGVSLKRGALVVEDNDSGVPVEETKKQKLSECSLTKGQDGLQNDFLSISEDVPRPPDTVSTGKGGKNSEAQLEDEEEEEEDGLSEECEEEESESFADMMKHGLTEADVGITKFVSSHQGFSGILKERYSDFVVHEIGKDGRISHLNDLSIPVDEEDPSEDIFTVLTAEEKQRLEELQLFKNKETSVAIEVIEDTKEKRTIIHQAIKSLFPGLETKTEDREGKKYIVAYHAAGKKALANPRKHSWPKSRGSYCHFVLYKENKDTMDAINVLSKYLRVKPNIFSYMGTKDKRAITVQEIAVLKITAQRLAHLNKCLMNFKLGNFSYQKNPLKLGELQGNHFTVVLRNITGTDDQVQQAMNSLKEIGFINYYGMQRFGTTAVPTYQVGRAILQNSWTEVMDLILKPRSGAEKGYLVKCREEWAKTKDPTAALRKLPVKRYPEIIA

SEQ ID NO: 69872 - protein, 701 aa, Homo sapiens
  Payload ID: 13879
  Gene Symbol: PUS7L
  Gene Name: pseudouridylate synthase 7-like
  Uniprot ID: Q9H0K6
  ENSP ID: ENSP00000343081
MEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRILDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNRAKKYFLQTEDAKGTLSLMPEFKVRERALLEALHRFGMTEEGCIQAWFSLPHSMRIFYVHAYTSKIWNEAVSYRLETYGARVVQGDLVCLDEDIDDENFPNSKIHLVTEEEGSANMYAIHQVVLPVLGYNIQYPKNKVGQWYHDILSRDGLQTCRFKVPTLKLNIPGCYRQILKHPCNLSYQLMEDHDIDVKTKGSHIDETALSLLISFDLDASCYATVCLKEIMKHDV

SEQ ID NO: 69873 - protein, 388 aa, Homo sapiens
  Payload ID: 13879
  Gene Symbol: PUS7L
  Gene Name: pseudouridylate synthase 7-like
  Uniprot ID: Q9H0K6
  ENSP ID: ENSP00000398497
MFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNRAKKYFLQTEDAKGTLSLMPEFKVRERALLEALHRFGMTEEGCIQAWFSLPHSMRIFYVHAYTSKIWNEAVSYRLETYGARVVQGDLVCLDEDIDDENFPNSKIHLVTEEEGSANMYAIHQVVLPVLGYNIQYPKNKVGQWYHDILSRDGLQTCRFKVPTLKLNIPGCYRQILKHPCNLSYQLMEDHDIDVKTKGSHIDETALSLLISFDLDASCYATVCLKEIMKHDV

SEQ ID NO: 69874 - protein, 701 aa, Homo sapiens; identical to SEQ ID NO: 69872
  Payload ID: 13879
  Gene Symbol: PUS7L
  Gene Name: pseudouridylate synthase 7-like
  Uniprot ID: Q9H0K6
  ENSP ID: ENSP00000415899

SEQ ID NO: 69875 - protein, 365 aa, Homo sapiens
  Payload ID: 13879
  Gene Symbol: PUS7L
  Gene Name: pseudouridylate synthase 7-like
  ENSP ID: ENSP00000446865
MEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRILDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEI

SEQ ID NO: 69876 - protein, 701 aa, Homo sapiens; identical to SEQ ID NO: 69872
  Payload ID: 13879
  Gene Symbol: PUS7L
  Gene Name: pseudouridylate synthase 7-like
  Uniprot ID: Q9H0K6
  ENSP ID: ENSP00000447706

SEQ ID NO: 69877 - protein, 160 aa, Homo sapiens
  Payload ID: 13879
  Gene Symbol: PUS7L
  Gene Name: pseudouridylate synthase 7-like
  ENSP ID: ENSP00000449222
MFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNR

SEQ ID NO: 69878 - protein, 126 aa, Homo sapiens
  Payload ID: 13879
  Gene Symbol: PUS7L
  Gene Name: pseudouridylate synthase 7-like
  ENSP ID: ENSP00000449502
MEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLS

SEQ ID NO: 69879 - protein, 154 aa, Homo sapiens
  Payload ID: 13879
  Gene Symbol: PUS7L
  Gene Name: pseudouridylate synthase 7-like
  ENSP ID: ENSP00000450341
MFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDL

SEQ ID NO: 69880 - protein, 303 aa, Homo sapiens
  Payload ID: 13880
  Gene Symbol: PUSL1
  Gene Name: pseudouridylate synthase-like 1
  Uniprot ID: Q8N0Z8
  ENSP ID: ENSP00000368318
MSSAPASGSVRARYLVYFQYVGTDFNGVAAVRGTQRAVGVQNYLEEAAERLNSVEPVRFTISSRTDAGVHALSNAAHLDVQRRSGRPPFPPEVLAEALNTHLRHPAIRVLRAFRVPSDFHARHAATSRTYLYRLATGCHRRDELPVFERNLCWTLPADCLDMVAMQEAAQHLLGTHDFSAFQSAGSPVPSPVRTLRRVSVSPGQASPLVTPEESRKLRFWNLEFESQSFLYRQVRRMTAVLVAVGLGALAPAQVKTILESQDPLGKHQTRVAPAHGLFLKSVLYGNLGAASCTLQGPQFGSHG

SEQ ID NO: 69881 - protein, 125 aa, Homo sapiens
  Payload ID: 13880
  Gene Symbol: PUSL1
  Gene Name: pseudouridylate synthase-like 1
  ENSP ID: ENSP00000462968
MVAMQEAAQHLLGTHDFSAFQSAGSPVPSPVRTLRRVSVSPGQASPLVTPEESRKLRFWNLEFESQSFLYRQVRRMTAVLVAVGLGALAPAQVKTILESQDPLGKHQTRVAPAHGLFLKSVLYGN

SEQ ID NO: 69882 - protein, 205 aa, Homo sapiens
  Payload ID: 13881
  Gene Symbol: PSMC3IP
  Gene Name: PSMC3 interacting protein
  Uniprot ID: Q9P2W1
  ENSP ID: ENSP00000253789
MSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 69883 - protein, 217 aa, Homo sapiens
  Payload ID: 13881
  Gene Symbol: PSMC3IP
  Gene Name: PSMC3 interacting protein
  Uniprot ID: Q9P2W1
  ENSP ID: ENSP00000377384
MSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 69884 - protein, 85 aa, Homo sapiens
  Payload ID: 13881
  Gene Symbol: PSMC3IP
  Gene Name: PSMC3 interacting protein
  ENSP ID: ENSP00000465409
MSKGRAEAAAGAAGILLRYLQEQNRPYSSQDVFGNLQREHGLGKAVVVKTLEQLAQQGKIKEKMYGKQKIYFADQVRRTCADCHP

SEQ ID NO: 69885 - protein, 84 aa, Homo sapiens
  Payload ID: 13881
  Gene Symbol: PSMC3IP
  Gene Name: PSMC3 interacting protein
  ENSP ID: ENSP00000466031
MSKGRAEAAAGAAGILLRYLQEQNRPYSSQDVFGNLQREHGLGKAVVVKTLEQLAQQGKIKEKMYGKQKIYFADQTLWRLWGPV

SEQ ID NO: 69886 - protein, 92 aa, Homo sapiens
  Payload ID: 13881
  Gene Symbol: PSMC3IP
  Gene Name: PSMC3 interacting protein
  Uniprot ID: Q9P2W1
  ENSP ID: ENSP00000466381
MQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 69887 - protein, 116 aa, Homo sapiens
  Payload ID: 13881
  Gene Symbol: PSMC3IP
  Gene Name: PSMC3 interacting protein
  ENSP ID: ENSP00000467952
MSKGRAEAAAGAAGILLRYLQEQNRPYSSQDVFGNLQREHGLGKAVVVKTLEQLAQQGKIKEKMYGKQKIYFADQDQFDMVSDADLQVLDGKIVALTAKVQSLQQSCRYMEAGRTG

SEQ ID NO: 69888 - protein, 154 aa, Homo sapiens
  Payload ID: 13881
  Gene Symbol: PSMC3IP
  Gene Name: PSMC3 interacting protein
  ENSP ID: ENSP00000468188
MYGKQKIYFADQDQFDMVSDADLQVLDGKIVALTAKVQSLQQSCRYMEAELKELSSALTTPEMQKEIQELKKECAGYRERLKNIKAATNHVTPEEKEQVYRERQKYCKEWRKRKRMATELSDAILEGYPKSKKQFFEEVGIETDEDYNVTLPDP

SEQ ID NO: 69889 - protein, 152 aa, Homo sapiens
  Payload ID: 13882
  Gene Symbol: PSORS1C1
  Gene Name: psoriasis susceptibility 1 candidate 1
  Uniprot ID: Q9UIG5
  ENSP ID: ENSP00000259881
MTCTDQKSHSQRALGTQTPALQGPQLLNTDPSSEETRPPHVNPDRLCHMEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 69890 - protein, 63 aa, Homo sapiens
  Payload ID: 13882
  Gene Symbol: PSORS1C1
  Gene Name: psoriasis susceptibility 1 candidate 1
  ENSP ID: ENSP00000365466
MTCTDQKSHSQRALGTQTPALQGPQLLNTDPSSEETHPPTLILTDFATWSQQTISGMQGTSKQ

SEQ ID NO: 69891 - protein, 152 aa, Homo sapiens; identical to SEQ ID NO: 69889
  Payload ID: 13882
  Gene Symbol: PSORS1C1
  Gene Name: psoriasis susceptibility 1 candidate 1
  Uniprot ID: Q9UIG5
  ENSP ID: ENSP00000389875

SEQ ID NO: 69892 - protein, 152 aa, Homo sapiens
  Payload ID: 13882
  Gene Symbol: PSORS1C1
  Gene Name: psoriasis susceptibility 1 candidate 1
  Uniprot ID: Q9UIG5
  ENSP ID: ENSP00000391443
MTCTDQKSHSQRALGTQTPALQGPQLLNTDPSSKETRPPHVNPDRLCHMEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 69893 - protein, 152 aa, Homo sapiens; identical to SEQ ID NO: 69889
  Payload ID: 13882
  Gene Symbol: PSORS1C1
  Gene Name: psoriasis susceptibility 1 candidate 1
  Uniprot ID: Q9UIG5
  ENSP ID: ENSP00000396568

SEQ ID NO: 69894 - protein, 152 aa, Homo sapiens; identical to SEQ ID NO: 69889
  Payload ID: 13882
  Gene Symbol: PSORS1C1
  Gene Name: psoriasis susceptibility 1 candidate 1
  Uniprot ID: Q9UIG5
  ENSP ID: ENSP00000398278

SEQ ID NO: 69895 - protein, 89 aa, Homo sapiens
  Payload ID: 13882
  Gene Symbol: PSORS1C1
  Gene Name: psoriasis susceptibility 1 candidate 1
  ENSP ID: ENSP00000447158
MISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 69896 - protein, 104 aa, Homo sapiens
  Payload ID: 13882
  Gene Symbol: PSORS1C1
  Gene Name: psoriasis susceptibility 1 candidate 1
  ENSP ID: ENSP00000449471
MEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 69897 - protein, 136 aa, Homo sapiens
  Payload ID: 13883
  Gene Symbol: PSORS1C2
  Gene Name: psoriasis susceptibility 1 candidate 2
  Uniprot ID: Q9UIG4
  ENSP ID: ENSP00000259845
MILNWKLLGILVLCLHTRGISGSEGHPSHPPAEDREEAGSPTLPQGPPVPGDPWPGAPPLFEDPPPTRPSRPWRDLPETGVWLPEPPRTDPPQPPRPDDPWPAGPQPPENPWPPAPEVDNRPQEEPDLDPPREEYR

SEQ ID NO: 69898 - protein, 136 aa, Homo sapiens
  Payload ID: 13883
  Gene Symbol: PSORS1C2
  Gene Name: psoriasis susceptibility 1 candidate 2
  Uniprot ID: Q9UIG4
  ENSP ID: ENSP00000373022
MILNWKLLGILVLCLHTRGISGSEGHPSHPPAEDREEAGSPTLPQGPPVPGDPWPGAPPLFEDPPPTRPSRPWRDLPETGVWPPEPPRTDPPQPPRPDDPWPAGPQPPENPWPPAPEVDNRPQEEPDLDPPREEYR

SEQ ID NO: 69899 - protein, 136 aa, Homo sapiens; identical to SEQ ID NO: 69898
  Payload ID: 13883
  Gene Symbol: PSORS1C2
  Gene Name: psoriasis susceptibility 1 candidate 2
  Uniprot ID: Q9UIG4
  ENSP ID: ENSP00000390931

SEQ ID NO: 69900 - protein, 136 aa, Homo sapiens; identical to SEQ ID NO: 69898
  Payload ID: 13883
  Gene Symbol: PSORS1C2
  Gene Name: psoriasis susceptibility 1 candidate 2
  Uniprot ID: Q9UIG4
  ENSP ID: ENSP00000398734

SEQ ID NO: 69901 - protein, 136 aa, Homo sapiens; identical to SEQ ID NO: 69898
  Payload ID: 13883
  Gene Symbol: PSORS1C2
  Gene Name: psoriasis susceptibility 1 candidate 2
  Uniprot ID: Q9UIG4
  ENSP ID: ENSP00000403456

SEQ ID NO: 69902 - protein, 136 aa, Homo sapiens; identical to SEQ ID NO: 69898
  Payload ID: 13883
  Gene Symbol: PSORS1C2
  Gene Name: psoriasis susceptibility 1 candidate 2
  Uniprot ID: Q9UIG4
  ENSP ID: ENSP00000414952

SEQ ID NO: 69903 - protein, 304 aa, Homo sapiens
  Payload ID: 13884
  Gene Symbol: PPTC7
  Gene Name: PTC7 protein phosphatase homolog
  Uniprot ID: Q8NI37
  ENSP ID: ENSP00000346255
MFSVLSYGRLVARAVLGGLSQTDPRAGGGGGGDYGLVTAGCGFGKDFRKGLLKKGACYGDDACFVARHRSADVLGVADGVGGWRDYGVDPSQFSGTLMRTCERLVKEGRFVPSNPIGILTTSYCELLQNKVPLLGSSTACIVVLDRTSHRLHTANLGDSGFLVVRGGEVVHRSDEQQHYFNTPFQLSIAPPEAEGVVLSDSPDAADSTSFDVQLGDIILTATDGLFDNMPDYMILQELKKLKNSNYESIQQTARSIAEQAHELAYDPNYMSPFAQFACDNGLNVRGGKPDDITVLLSIVAEYTD

SEQ ID NO: 69904 - protein, 581 aa, Homo sapiens
  Payload ID: 13885
  Gene Symbol: PINK1
  Gene Name: PTEN induced putative kinase 1
  Uniprot ID: Q9BXM7
  ENSP ID: ENSP00000364204
MAVRQALGRGLQLGRALLLRFTGKPGRAYGLGRPGPAAGCVRGERPGWAAGPGAEPRRVGLGLPNRLRFFRQSVAGLAARLQRQFVVRAWGCAGPCGRAVFLAFGLGLGLIEEKQAESRRAVSACQEIQAIFTQKSKPGPDPLDTRRLQGFRLEEYLIGQSIGKGCSAAVYEATMPTLPQNLEVTKSTGLLPGRGPGTSAPGEGQERAPGAPAFPLAIKMMWNISAGSSSEAILNTMSQELVPASRVALAGEYGAVTYRKSKRGPKQLAPHPNIIRVLRAFTSSVPLLPGALVDYPDVLPSRLHPEGLGHGRTLFLVMKNYPCTLRQYLCVNTPSPRLAAMMLLQLLEGVDHLVQQGIAHRDLKSDNILVELDPDGCPWLVIADFGCCLADESIGLQLPFSSWYVDRGGNGCLMAPEVSTARPGPRAVIDYSKADAWAVGAIAYEIFGLVNPFYGQGKAHLESRSYQEAQLPALPESVPPDVRQLVRALLQREASKRPSARVAANVLHLSLWGEHILALKNLKLDKMVGWLLQQSAATLLANRLTEKCCVETKMKMLFLANLECETLCQAALLLCSWRAAL

SEQ ID NO: 69905 - protein, 104 aa, Homo sapiens
  Payload ID: 13886
  Gene Symbol: PCBD1
  Gene Name: pterin-4 alpha-carbinolamine dehydratase/dimerization cofactor of hepatocyte nuclear factor 1 alpha
  Uniprot ID: P61457
  ENSP ID: ENSP00000299299
MAGKAHRLSAEERDQLLPNLRAVGWNELEGRDAIFKQFHFKDFNRAFGFMTRVALQAEKLDHHPEWFNVYNKVHITLSTHECAGLSERDINLASFIEQVAVSMT

SEQ ID NO: 69906 - protein, 130 aa, Homo sapiens
  Payload ID: 13887
  Gene Symbol: PCBD2
  Gene Name: pterin-4 alpha-carbinolamine dehydratase/dimerization cofactor of hepatocyte nuclear factor 1 alpha (TCF1) 2
  Uniprot ID: Q9H0N5
  ENSP ID: ENSP00000254908
MAAVLGALGATRRLLAALRGQSLGLAAMSSGTHRLTAEERNQAILDLKAAGWSELSERDAIYKEFSFHNFNQAFGFMSRVALQAEKMNHHPEWFNVYNKVQITLTSHDCGELTKKDVKLAKFIEKAAASV

SEQ ID NO: 69907 - protein, 130 aa, Homo sapiens; identical to SEQ ID NO: 69906
  Payload ID: 13887
  Gene Symbol: PCBD2
  Gene Name: pterin-4 alpha-carbinolamine dehydratase/dimerization cofactor of hepatocyte nuclear factor 1 alpha (TCF1) 2
  Uniprot ID: Q9H0N5
  ENSP ID: ENSP00000421544

SEQ ID NO: 69908 - protein, 119 aa, Homo sapiens
  Payload ID: 13887
  Gene Symbol: PCBD2
  Gene Name: pterin-4 alpha-carbinolamine dehydratase/dimerization cofactor of hepatocyte nuclear factor 1 alpha (TCF1) 2
  ENSP ID: ENSP00000426161
RRLLAALRGQSLGLAAMSSGTHRLTAEERNQAILDLKAAGWSELSERDAIYKEFSFHNFNQAFGFMSRVALQAEKMNHHPEWFNVYNKVQITLTSHDCGELTKKDVKLAKFIEKAAASV

SEQ ID NO: 69909 - protein, 525 aa, Homo sapiens
  Payload ID: 13888
  Gene Symbol: PTGES3L-AARSD1
  Gene Name: PTGES3L-AARSD1 readthrough
  Uniprot ID: Q9BTE6
  ENSP ID: ENSP00000353355
MEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 69910 - protein, 495 aa, Homo sapiens
  Payload ID: 13888
  Gene Symbol: PTGES3L-AARSD1
  Gene Name: PTGES3L-AARSD1 readthrough
  ENSP ID: ENSP00000386254
MEFCVEDSTDVHVLIEDHRIVFSCKNADGVELYNEIEFYAKVNSKDSQDKRSSRSITCFVRKWKEKVAWPRLTKEDIKLLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 69911 - protein, 586 aa, Homo sapiens
  Payload ID: 13888
  Gene Symbol: PTGES3L-AARSD1
  Gene Name: PTGES3L-AARSD1 readthrough
  Uniprot ID: Q9BTE6
  ENSP ID: ENSP00000386621
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 69912 - protein, 189 aa, Homo sapiens
  Payload ID: 13888
  Gene Symbol: PTGES3L-AARSD1
  Gene Name: PTGES3L-AARSD1 readthrough
  ENSP ID: ENSP00000393019
  MOD_RES (1)..(1): Any amino acid
XQHARTLWYDRPSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTP

SEQ ID NO: 69913 - protein, 53 aa, Homo sapiens
  Payload ID: 13888
  Gene Symbol: PTGES3L-AARSD1
  Gene Name: PTGES3L-AARSD1 readthrough
  ENSP ID: ENSP00000393780
  MOD_RES (1)..(1): Any amino acid
XGSCWGRPQDLKIAAPAWNSKCHPGAGAAMARHTSTSLQAARPDLVVRQAQSK

SEQ ID NO: 69914 - protein, 132 aa, Homo sapiens
  Payload ID: 13888
  Gene Symbol: PTGES3L-AARSD1
  Gene Name: PTGES3L-AARSD1 readthrough
  ENSP ID: ENSP00000407951
MEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVV

SEQ ID NO: 69915 - protein, 586 aa, Homo sapiens; identical to SEQ ID NO: 69911
  Payload ID: 13888
  Gene Symbol: PTGES3L-AARSD1
  Gene Name: PTGES3L-AARSD1 readthrough
  Uniprot ID: Q9BTE6
  ENSP ID: ENSP00000409924

SEQ ID NO: 69916 - protein, 147 aa, Homo sapiens
  Payload ID: 13889
  Gene Symbol: PRY
  Gene Name: PTPN13-like, Y-linked
  Uniprot ID: O14603
  ENSP ID: ENSP00000302319
MGATGLGFLLSWRQDNLNGTDCQGCNILYFSETTGSMCSELSLNRGLEARRKKDLKDSFLWRYGKVGCISLPLREMTAWINPPQISEIFQGYHQRVHGADALSLQTNSLRSRLSSQCLGQSFLLRTLERGRGFRALGDICGHVHEED

SEQ ID NO: 69917 - protein, 71 aa, Homo sapiens
  Payload ID: 13889
  Gene Symbol: PRY
  Gene Name: PTPN13-like, Y-linked
  Uniprot ID: O14603
  ENSP ID: ENSP00000474674
MGATGLGFLLSWRQDNLNGTDCQGCNILYFSETTGSMCSELSLNRGLEARRKKDLKDSFLWRDGVSPCLPC

SEQ ID NO: 69918 - protein, 147 aa, Homo sapiens; identical to SEQ ID NO: 69916
  Payload ID: 13890
  Gene Symbol: PRY2
  Gene Name: PTPN13-like, Y-linked 2
  Uniprot ID: O14603
  ENSP ID: ENSP00000303300

SEQ ID NO: 69919 - protein, 71 aa, Homo sapiens; identical to SEQ ID NO: 69917
  Payload ID: 13890
  Gene Symbol: PRY2
  Gene Name: PTPN13-like, Y-linked 2
  Uniprot ID: O14603
  ENSP ID: ENSP00000474545

SEQ ID NO: 69920 - protein, 1505 aa, Homo sapiens; identical to SEQ ID NO: 69309
  Payload ID: 13891
  Gene Symbol:
  Gene Name: PTPRD
  ENSP ID: ENSP00000488982

SEQ ID NO: 69921 - protein, 1506 aa, Homo sapiens; identical to SEQ ID NO: 69306
  Payload ID: 13891
  Gene Symbol:
  Gene Name: PTPRD
  ENSP ID: ENSP00000489038

SEQ ID NO: 69922 - protein, 93 aa, Homo sapiens; identical to SEQ ID NO: 69314
  Payload ID: 13891
  Gene Symbol:
  Gene Name: PTPRD
  ENSP ID: ENSP00000489062

SEQ ID NO: 69923 - protein, 1912 aa, Homo sapiens; identical to SEQ ID NO: 69307
  Payload ID: 13891
  Gene Symbol:
  Gene Name: PTPRD
  ENSP ID: ENSP00000489063

SEQ ID NO: 69924 - protein, 1502 aa, Homo sapiens; identical to SEQ ID NO: 69310
  Payload ID: 13891
  Gene Symbol:
  Gene Name: PTPRD
  ENSP ID: ENSP00000489155

SEQ ID NO: 69925 - protein, 1505 aa, Homo sapiens [sequence omitted]

SEQ ID NO: 69926 - protein, 1912 aa, Homo sapiens; identical to SEQ ID NO: 69307
  Payload ID: 13891
  Gene Symbol:
  Gene Name: PTPRD
  ENSP ID: ENSP00000489257

SEQ ID NO: 69927 - protein, 1496 aa, Homo sapiens; identical to SEQ ID NO: 69316
  Payload ID: 13891
  Gene Symbol:
  Gene Name: PTPRD
  ENSP ID: ENSP00000489264

SEQ ID NO: 69928 - protein, 1912 aa, Homo sapiens; identical to SEQ ID NO: 69307
  Payload ID: 13891
  Gene Symbol:
  Gene Name: PTPRD
  ENSP ID: ENSP00000489439

SEQ ID NO: 69929 - protein, 1505 aa, Homo sapiens; identical to SEQ ID NO: 69312
  Payload ID: 13891
  Gene Symbol:
  Gene Name: PTPRD
  ENSP ID: ENSP00000489509

SEQ ID NO: 69930 - protein, 202 aa, Homo sapiens; identical to SEQ ID NO: 69313
  Payload ID: 13891
  Gene Symbol:
  Gene Name: PTPRD
  ENSP ID: ENSP00000489546

SEQ ID NO: 69931 - protein, 1005 aa, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENSP ID: ENSP00000228425
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEKNIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLDRKRSASAPTLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 69932 - protein, 1011 aa, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENSP ID: ENSP00000314724
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 69933 - protein, 86 aa, Homo sapiens
  Payload ID: 13892
  Gene Symbol: PPFIBP1
  Gene Name: PTPRF interacting protein, binding protein 1 (liprin beta 1)
  ENSP ID: ENSP00000437438
MMSDASDMLAAALEQMDGIIAGSKALEYSNGIFDCQSPTSPFMGSLRALHLVEDLRGLLEMMETDEKEGLRCQIPDSTAETLVEWL

SEQ ID NO: 69934 - protein, 109 aa, Homo sapiens
  Payload ID: 13892
  Gene Symbol: PPFIBP1
  Gene Name: PTPRF interacting protein, binding protein 1 (liprin beta 1)
  ENSP ID: ENSP00000438036
MMSDASDMLAAALEQMDGIIAGSKALEYSNGIFDCQSPTSPFMGSLRALHLVEDLRGLLEMMETDEKEGLRCQIPDSTAETLVEWLQSQMVGSACSKFCYKSFVAYSKI

SEQ ID NO: 69935 - protein, 242 aa, Homo sapiens
  Payload ID: 13892
  Gene Symbol: PPFIBP1
  Gene Name: PTPRF interacting protein, binding protein 1 (liprin beta 1)
  ENSP ID: ENSP00000438174
  MOD_RES (1)..(1): Any amino acid
XDIGLPQYKTQFDEGRVDGRMLHYMTVNTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 69936 - protein, 18 aa, Homo sapiens
  Payload ID: 13892
  Gene Symbol: PPFIBP1
  Gene Name: PTPRF interacting protein, binding protein 1 (liprin beta 1)
  ENSP ID: ENSP00000442462
MLQQELLSRTSLETQKLD

SEQ ID NO: 69937 - protein, 205 aa, Homo sapiens
  Payload ID: 13892
  Gene Symbol: PPFIBP1
  Gene Name: PTPRF interacting protein, binding protein 1 (liprin beta 1)
  ENSP ID: ENSP00000443324
NEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGDRAPAESRPFGTLPPRPPGQDTSMDDNPFGTRKVRSSFGRGFF

SEQ ID NO: 69938 - protein, 980 aa, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENSP ID: ENSP00000443442
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 69939 - protein, 170 aa, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENSP ID: ENSP00000444046
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQVCAEARTKMGFPC

SEQ ID NO: 69940 - protein, 744 aa, Homo sapiens
  Payload ID: 13892
  Gene Symbol: PPFIBP1
  Gene Name: PTPRF interacting protein, binding protein 1 (liprin beta 1)
  ENSP ID: ENSP00000444304
MAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNL

SEQ ID NO: 69941 - protein, 152 aa, Homo sapiens
  Payload ID: 13892
  Gene Symbol: PPFIBP1
  Gene Name: PTPRF interacting protein, binding protein 1 (liprin beta 1)
  ENSP ID: ENSP00000445132
MHLGWNLPLTNNKMMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEF

SEQ ID NO: 69942 - protein, 858 aa, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENSP ID: ENSP00000445425
MLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 69943 - protein, 281 aa, Homo sapiens
  Payload ID: 13892
  Gene Symbol: PPFIBP1
  Gene Name: PTPRF interacting protein, binding protein 1 (liprin beta 1)
  ENSP ID: ENSP00000445822
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEK

SEQ ID NO: 69944 - protein, 86 aa, Homo sapiens
  Payload ID: 13892
  Gene Symbol: PPFIBP1
  Gene Name: PTPRF interacting protein, binding protein 1 (liprin beta 1)
  ENSP ID: ENSP00000479763
DRAPAESRPFGTLPPRPPGQDTSMDDNPFGTRKVRSSFGRGFFKIKSNKRTASAPNLGTYDQNAFALILPQGGKEQCLPFPYSFIH

SEQ ID NO: 69945 - protein, 876 aa, Homo sapiens
  Payload ID: 13893
  Gene Symbol: PPFIBP2
  Gene Name: PTPRF interacting protein, binding protein 2 (liprin beta 2)
  Uniprot ID: Q8ND30
  ENSP ID: ENSP00000299492
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 69946 - protein, 89 aa, Homo sapiens
  Payload ID: 13893
  Gene Symbol: PPFIBP2
  Gene Name: PTPRF interacting protein, binding protein 2 (liprin beta 2)
  ENSP ID: ENSP00000431724
MASDASHALEAALEQMDGIIAGTKTGADLSDGTCEPGLASPASYMNPFPVLHLIEDLRLALEMLELPQERAALLSQIPGPTAAYIKEWF

SEQ ID NO: 69947 - protein, 70 aa, Homo sapiens
  Payload ID: 13893
  Gene Symbol: PPFIBP2
  Gene Name: PTPRF interacting protein, binding protein 2 (liprin beta 2)
  ENSP ID: ENSP00000433026
MASDASHALEAALEQMDGIIAGTKTGADLSDGTCEPGLASPASYMNPFPVLHLIEDLRLALEMLELPQER

SEQ ID NO: 69948 - protein, 225 aa, Homo sapiens
  Payload ID: 13893
  Gene Symbol: PPFIBP2
  Gene Name: PTPRF interacting protein, binding protein 2 (liprin beta 2)
  ENSP ID: ENSP00000433713
  MOD_RES (1)..(1): Any amino acid
XGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLNRGRSVSAPVLGDTESGWDDTAVVNDLSSTSSGTESGPQSPLTPDGKRNPKGIKKFWGKIRRTQSGNFYTDTLGMAEFRRGGLRATA

SEQ ID NO: 69949 - protein, 86 aa, Homo sapiens
  Payload ID: 13893
  Gene Symbol: PPFIBP2
  Gene Name: PTPRF interacting protein, binding protein 2 (liprin beta 2)
  ENSP ID: ENSP00000433839
MLQQELLSRTSLETQKLDLMTEVSELKLKLVGMEKEQREQEEKQRKAEELLQELRHLKIKVEELENERNQYEWKLKATKAEVAQLQ

SEQ ID NO: 69950 - protein, 136 aa, Homo sapiens
  Payload ID: 13893
  Gene Symbol: PPFIBP2
  Gene Name: PTPRF interacting protein, binding protein 2 (liprin beta 2)
  ENSP ID: ENSP00000433917
  MOD_RES (1)..(1): Any amino acid
XPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQICNLVLRFCMLNIIFFPFK

SEQ ID NO: 69951 - protein, 89 aa, Homo sapiens; identical to SEQ ID NO: 69946
  Payload ID: 13893
  Gene Symbol: PPFIBP2
  Gene Name: PTPRF interacting protein, binding protein 2 (liprin beta 2)
  ENSP ID: ENSP00000434641

SEQ ID NO: 69952 - protein, 170 aa, Homo sapiens
  Payload ID: 13893
  Gene Symbol: PPFIBP2
  Gene Name: PTPRF interacting protein, binding protein 2 (liprin beta 2)
  ENSP ID: ENSP00000434981
MASDASHALEAALEQMDGIIAGTKTGADLSDGTCEPGLASPASYMNPFPVLHLIEDLRLALEMLELPQERAALLSQIPGPTAAYIKEWFEESLSQVNHHSAASNETYQERLARLEGDKESLILQVSVLTDQVEAQGEKIRDLEVCLEGHQVKLNAAEEMLQQELLSRTSL

SEQ ID NO: 69953 - protein, 764 aa, Homo sapiens
  Payload ID: 13893
  Gene Symbol: PPFIBP2
  Gene Name: PTPRF interacting protein, binding protein 2 (liprin beta 2)
  Uniprot ID: Q8ND30
  ENSP ID: ENSP00000435469
MSSEQWPRLPGKVSVLTDQVEAQGEKIRDLEVCLEGHQVKLNAAEEMLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 69954 - protein, 155 aa, Homo sapiens
  Payload ID: 13893
  Gene Symbol: PPFIBP2
  Gene Name: PTPRF interacting protein, binding protein 2 (liprin beta 2)
  ENSP ID: ENSP00000435794
MLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKV

SEQ ID NO: 69955 - protein, 149 aa, Homo sapiens
  Payload ID: 13893
  Gene Symbol: PPFIBP2
  Gene Name: PTPRF interacting protein, binding protein 2 (liprin beta 2)
  ENSP ID: ENSP00000436489
  MOD_RES (1)..(1): Any amino acid
XKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQHQWKHMNFDAGPETMDTPTRLSSQAPPTLQLREKLKCLRPVDHSLG

SEQ ID NO: 69956 - protein, 718 aa, Homo sapiens
  Payload ID: 13893
  Gene Symbol: PPFIBP2
  Gene Name: PTPRF interacting protein, binding protein 2 (liprin beta 2)
  ENSP ID: ENSP00000436498
MLQQELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 69957 - protein, 181 aa, Homo sapiens
  Payload ID: 13893
  Gene Symbol: PPFIBP2
  Gene Name: PTPRF interacting protein, binding protein 2 (liprin beta 2)
  ENSP ID: ENSP00000436739
MPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLNRGRSVSAPVLGTVPIPGDTESGWDDTAVVNDLSSTSSGTESGPQSPLTPDGKRNPKGIKKFWGKIRRTQSGNFYTDTL

SEQ ID NO: 69958 - protein, 733 aa, Homo sapiens
  Payload ID: 13893
  Gene Symbol: PPFIBP2
  Gene Name: PTPRF interacting protein, binding protein 2 (liprin beta 2)
  Uniprot ID: Q8ND30
  ENSP ID: ENSP00000437321
MGKLITRMWKLLRRRSAPKELLSRTSLETQKLDLMTEVSELKLKLVGMEKEQREQEEKQRKAEELLQELRHLKIKVEELENERNQYEWKLKATKAEVAQLQEQVALKDAEIERLHSQLSRTAALHSESHTERDQEIQRLKMGMETLLLANEDKDRRIEELTGLLNQYRKVKEIVMVTQGPSERTLSINEEEPEGGFSKWNATNKDPEELFKQEMPPRCSSPTVGPPPLPQKSLETRAQKKLSCSLEDLRSESVDKCMDGNQPFPVLEPKDSPFLAEHKYPTLPGKLSGATPNGEAAKSPPTICQPDATGSSLLRLRDTESGWDDTAVVNDLSSTSSGTESGPQSPLTPDGKRNPKGIKKFWGKIRRTQSGNFYTDTLGMAEFRRGGLRATAGPRLSRTRDSKGQKSDANAPFAQWSTERVCAWLEDFGLAQYVIFARQWVSSGHTLLTATPQDMEKELGIKHPLHRKKLVLAVKAINTKQEEKSALLDHIWVTRWLDDIGLPQYKDQFHESRVDRRMLQYLTVNDLLFLKVTSQLHHLSIKCAIHVLHVNKFNPHCLHRRPADESNLSPSEVVQWSNHRVMEWLRSVDLAEYAPNLRGSGVHGGLIILEPRFTGDTLAMLLNIPPQKTLLRRHLTTKFNALIGPEAEQEKREKMASPAYTPLTTTAKVRPRKLGFSHFGNIRKKKFDESTDYICPMEPSDGVSDSHRVYSGYRGLSPLDAPELDGLDQVGQIS

SEQ ID NO: 69959 - protein, 1186 aa, Homo sapiens
  Payload ID: 13894
  Gene Symbol: PUM1
  Gene Name: pumilio RNA-binding family member 1
  Uniprot ID: Q14671
  ENSP ID: ENSP00000257075
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69960 - protein, 1224 aa, Homo sapiens
  Payload ID: 13894
  Gene Symbol: PUM1
  Gene Name: pumilio RNA-binding family member 1
  ENSP ID: ENSP00000362846
MPLPPPGPGPEPIPGCTAPTQSPVGRHVVGVKGVGGMSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69961 - protein, 1127 aa, Homo sapiens
  Payload ID: 13894
  Gene Symbol: PUM1
  Gene Name: pumilio RNA-binding family member 1
  Uniprot ID: Q14671
  ENSP ID: ENSP00000362847
MPLPPPGPGPEPIPGCTAPTQSPVGRHVVGVKGVGGMSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIAGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69962 - protein, 1189 aa, Homo sapiens
  Payload ID: 13894
  Gene Symbol: PUM1
  Gene Name: pumilio RNA-binding family member 1
  ENSP ID: ENSP00000362852
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIAGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69963 - protein, 1188 aa, Homo sapiens
  Payload ID: 13894
  Gene Symbol: PUM1
  Gene Name: pumilio RNA-binding family member 1
  Uniprot ID: Q14671
  ENSP ID: ENSP00000391723
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69964 - protein, 944 aa, Homo sapiens
  Payload ID: 13894
  Gene Symbol: PUM1
  Gene Name: pumilio RNA-binding family member 1
  ENSP ID: ENSP00000400141
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGELFQRPNALAVQQLTAAQQQQYALAAAHQPHIGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69965 - protein, 1162 aa, Homo sapiens
  Payload ID: 13894
  Gene Symbol: PUM1
  Gene Name: pumilio RNA-binding family member 1
  Uniprot ID: Q14671
  ENSP ID: ENSP00000401777
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIAGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69966 - protein, 227 aa, Homo sapiens
  Payload ID: 13894
  Gene Symbol: PUM1
  Gene Name: pumilio RNA-binding family member 1
  ENSP ID: ENSP00000431213
AGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQDQYGNYVIQHVLEHGRPEDKSKIVAEIRGNVLVLSQHKFASNVVEKCVTHASRTERAVLIDEVCTMNDGPHSALYTMM

SEQ ID NO: 69967 - protein, 96 aa, Homo sapiens
  Payload ID: 13894
  Gene Symbol: PUM1
  Gene Name: pumilio RNA-binding family member 1
  ENSP ID: ENSP00000431470
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGG

SEQ ID NO: 69968 - protein, 90 aa, Homo sapiens
  Payload ID: 13894
  Gene Symbol: PUM1
  Gene Name: pumilio RNA-binding family member 1
  ENSP ID: ENSP00000431779
SLTGSSDLYKRTSSSLTPIGHSFYNGLSFSSSPGPVGMPLPSQGPGHSQTPPPSLSSHGSSSSLNLGAGFWKIFETTGTPIYNCGRLLDI

SEQ ID NO: 69969 - protein, 94 aa, Homo sapiens
  Payload ID: 13894
  Gene Symbol: PUM1
  Gene Name: pumilio RNA-binding family member 1
  ENSP ID: ENSP00000433099
MSVACVLKRKAVLWQDSFSPHLKHHPQEPANPNMPVVLTSGTGSQAQPQPAANQALAAGTHSSPVPGSIGVAGRSQDDAMVDYFFQRQHGAFHG

SEQ ID NO: 69970 - protein, 217 aa, Homo sapiens
  Payload ID: 13894
  Gene Symbol: PUM1
  Gene Name: pumilio RNA-binding family member 1
  ENSP ID: ENSP00000433373
  MOD_RES (1)..(1): Any amino acid
XEFSQDQHGSRFIQLKLERATPAERQLVFNEILQAAYQLMVDVFGNYVIQKFFEFGSLEQKLALAERIRGHVLSLALQMYGCRVIQKALEFIPSDQQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMM

SEQ ID NO: 69971 - protein, 900 aa, Homo sapiens
  Payload ID: 13894
  Gene Symbol: PUM1
  Gene Name: pumilio RNA-binding family member 1
  ENSP ID: ENSP00000433850
  MOD_RES (1)..(1): Any amino acid
XFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGMFSAGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAVANSNTGSGSRRDSLTGSSDLYKRTSSSLTPIGHSFYNGLSFSSSPGPVGMPLPSQGPGHSQTPPPSLSSHGSSSSLNLGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQVINEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69972 - protein, 76 aa, Homo sapiens
  Payload ID: 13894
  Gene Symbol: PUM1
  Gene Name: pumilio RNA-binding family member 1
  ENSP ID: ENSP00000434096
FIIDAFKGQVFALSTHPYGCRVIQRILEHCLPDQTLPILEELHQHTEQLVQVVELPVEELRTPVGLCRARVCVFCQ

SEQ ID NO: 69973 - protein, 265 aa, Homo sapiens
  Payload ID: 13894
  Gene Symbol: PUM1
  Gene Name: pumilio RNA-binding family member 1
  ENSP ID: ENSP00000435589
  MOD_RES (1)..(1): Any amino acid
XNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGA

SEQ ID NO: 69974 - protein, 1125 aa, Homo sapiens
  Payload ID: 13894
  Gene Symbol: PUM1
  Gene Name: pumilio RNA-binding family member 1
  ENSP ID: ENSP00000435825
  MOD_RES (1)..(1): Any amino acid
XQSPVGRHVVGVKGVGGMSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQVRSMDELNHDFQALALEGRAMGEQLLPGKKFWETDESSKDGPKGIFLGDQWRDSAWGTSDHSVSQPIMVQRRPGQSFHVNSEVNSVLSPRSESGGLGVSMVEYVLSSSPGDSCLRKGGFGPRDADSDENDKGEKKNKGTFDGDKLGDLKEEGDVMDKTNGLPVQNGIDADVKDFSRTPGNCQNSANEVDLLGPNQNGSEGLAQLTSTNGAKPVEDFSNMESQSVPLDPMEHVGMEPLQFDYSGTQVPVDSAAATVGLFDYNSQQQLFQRPNALAVQQLTAAQQQQYALAAAHQPHIAGLAPAAFVPNPYIISAAPPGTDPYTAGLAAAATLGPAVVPHQYYGVTPWGVYPASLFQQQAAAAAAATNSANQQTTPQAQQGQQQVLRGGASQRPLTPNQNQQGQQTDPLVAAAAVNSALAFGQGLAAGMPGYPVLAPAAYYDQTGALVVNAGARNGLGAPVRLVAPAPVIISSSAAQAAVAAAAASANGAAGGLAGTTNGPFRPLGTQQPQPQPQQQPNNNLASSSFYGNNSLNSNSQSSSLFSQGSAQPANTSLGFGSSSSLGATLGSALGGFGTAGGLTNGSGRYISAAPGAEAKYRSASSASSLFSPSSTLFSSSRLRYGMSDVMPSGRSRLLEDFRNNRYPNLQLREIAGHIMEFSQDQHGSRFIQLKLERATPAERQLVFNEILQAAYQLMVDVFGNYVIQKFFEFGSLEQKLALAERIRGHVLSLALQMYGCRVIQKALEFIPSDQQNEMVRELDGHVLKCVKDQNGNHVVQKCIECVQPQSLQFIIDAFKGQVFALSTHPYGCRVIQRILEHCLPDQTLPILEELHQHTEQLVQDQYGNYVIQHVLEHGRPEDKSKIVAEIRGNVLVLSQHKFASNVVEKCVTHASRTERAVLIDEVCTMNDGPHSALYTMMKDQYANYVVQKMIDVAEPGQRKIVMHKIRPHIATLRKYTYGKHILAKLEKYYMKNGVDLGPICGPPNGII

SEQ ID NO: 69975 - protein, 94 aa, Homo sapiens; identical to SEQ ID NO: 69969
  Payload ID: 13894
  Gene Symbol: PUM1
  Gene Name: pumilio RNA-binding family member 1
  ENSP ID: ENSP00000436921

SEQ ID NO: 69976 - protein, 124 aa, Homo sapiens
  Payload ID: 13894
  Gene Symbol: PUM1
  Gene Name: pumilio RNA-binding family member 1
  ENSP ID: ENSP00000437269
MSVACVLKRKAVLWQDSFSPHLKHHPQEPANPNMPVVLTSGTGSQAQPQPAANQALAAGTHSSPVPGSIGVAGRSQDDAMVDYFFQRQHGEQLGGGGSGGGGYNNSKHRWPTGDNIHAEHQEVL

SEQ ID NO: 69977 - protein, 929 aa, Homo sapiens
  Payload ID: 13895
  Gene Symbol: PUM2
  Gene Name: pumilio RNA-binding family member 2
  ENSP ID: ENSP00000326746
MSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 69978 - protein, 1064 aa, Homo sapiens
  Payload ID: 13895
  Gene Symbol: PUM2
  Gene Name: pumilio RNA-binding family member 2
  Uniprot ID: Q8TB72
  ENSP ID: ENSP00000338173
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 69979 - protein, 1008 aa, Homo sapiens
  Payload ID: 13895
  Gene Symbol: PUM2
  Gene Name: pumilio RNA-binding family member 2
  Uniprot ID: Q8TB72
  ENSP ID: ENSP00000354370
MSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 69980 - protein, 1064 aa, Homo sapiens; identical to SEQ ID NO: 69978
  Payload ID: 13895
  Gene Symbol: PUM2
  Gene Name: pumilio RNA-binding family member 2
  Uniprot ID: Q8TB72
  ENSP ID: ENSP00000385992

SEQ ID NO: 69981 - protein, 293 aa, Homo sapiens
  Payload ID: 13895
  Gene Symbol: PUM2
  Gene Name: pumilio RNA-binding family member 2
  ENSP ID: ENSP00000387399
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPH

SEQ ID NO: 69982 - protein, 34 aa, Homo sapiens
  Payload ID: 13895
  Gene Symbol: PUM2
  Gene Name: pumilio RNA-binding family member 2
  ENSP ID: ENSP00000395098
MNHDFQALALESRGMGELLPTKKFWEPDDSTKDG

SEQ ID NO: 69983 - protein, 40 aa, Homo sapiens
  Payload ID: 13895
  Gene Symbol: PUM2
  Gene Name: pumilio RNA-binding family member 2
  ENSP ID: ENSP00000396727
MNHDFQALALESRGMGETIQCPSLLWYREDLDRVFMETVK

SEQ ID NO: 69984 - protein, 35 aa, Homo sapiens
  Payload ID: 13895
  Gene Symbol: PUM2
  Gene Name: pumilio RNA-binding family member 2
  ENSP ID: ENSP00000408384
MNHDFQALALESRGMGEMQKRVQVSPLGHKRAPCS

SEQ ID NO: 69985 - protein, 876 aa, Homo sapiens
  Payload ID: 13895
  Gene Symbol: PUM2
  Gene Name: pumilio RNA-binding family member 2
  ENSP ID: ENSP00000409905
RFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 69986 - protein, 35 aa, Homo sapiens; identical to SEQ ID NO: 69984
  Payload ID: 13895
  Gene Symbol: PUM2
  Gene Name: pumilio RNA-binding family member 2
  ENSP ID: ENSP00000413515

SEQ ID NO: 69987 - protein, 648 aa, Homo sapiens
  Payload ID: 13896
  Gene Symbol: PUM3
  Gene Name: pumilio RNA-binding family member 3
  Uniprot ID: Q15397
  ENSP ID: ENSP00000380982
MEVKGKKQFTGKSTKTAQEKNRFHKNSDSGSSKTFPTRKVAKEGGPKVTSRNFEKSITKLGKKGVKQFKNKQQGDKSPKNKFQPANKFNKKRKFQPDGRSDESAAKKPKWDDFKKKKKELKQSRQLSDKTNYDIVVRAKQMWEILRRKDCDKEKRVKLMSDLQKLIQGKIKTIAFAHDSTRVIQCYIQYGNEEQRKQAFEELRDDLVELSKAKYSRNIVKKFLMYGSKPQIAEIIRSFKGHVRKMLRHAEASAIVEYAYNDKAILEQRNMLTEELYGNTFQLYKSADHRTLDKVLEVQPEKLELIMDEMKQILTPMAQKEAVIKHSLVHKVFLDFFTYAPPKLRSEMIEAIREAVVYLAHTHDGARVAMHCLWHGTPKDRKVIVKTMKTYVEKVANGQYSHLVLLAAFDCIDDTKLVKQIIISEIISSLPSIVNDKYGRKVLLYLLSPRDPAHTVREIIEVLQKGDGNAHSKKDTEVRRRELLESISPALLSYLQEHAQEVVLDKSACVLVSDILGSATGDVQPTMNAIASLAATGLHPGGKDGELHIAEHPAGHLVLKWLIEQDKKMKENGREGCFAKTLVEHVGMKNLKSWASVNRGAIILSSLLQSCDLEVANKVKAALKSLIPTLEKTKSTSKGIEILLEKLST

SEQ ID NO: 69988 - protein, 49 aa, Homo sapiens
  Payload ID: 13896
  Gene Symbol: PUM3
  Gene Name: pumilio RNA-binding family member 3
  ENSP ID: ENSP00000474467
AIILSSLLQSCDLEVANKVKAALKSLIPTLEKTKSTSKGIEILLEKLST

SEQ ID NO: 69989 - protein, 289 aa, Homo sapiens
  Payload ID: 13897
  Gene Symbol: PNP
  Gene Name: purine nucleoside phosphorylase
  Uniprot ID: P00491
  ENSP ID: ENSP00000354532
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 69990 - protein, 93 aa, Homo sapiens
  Payload ID: 13897
  Gene Symbol: PNP
  Gene Name: purine nucleoside phosphorylase
  ENSP ID: ENSP00000450663
MENGYTYEDYKNTAEWLLSHTKHRPQVAIICGSGLGGLTDKLTQAQIFDYGEIPNFPRSTVPGHAGRLVFGFLNGRACVMMQGRFHMYEGYPL

SEQ ID NO: 69991 - protein, 61 aa, Homo sapiens
  Payload ID: 13897
  Gene Symbol: PNP
  Gene Name: purine nucleoside phosphorylase
  ENSP ID: ENSP00000451108
MMQGRFHMYEGYPLWKVTFPVRVFHLLGVDTLVVTNAAGGLNPKFEVGDIMLIRDHINLPG

SEQ ID NO: 69992 - protein, 221 aa, Homo sapiens
  Payload ID: 13897
  Gene Symbol: PNP
  Gene Name: purine nucleoside phosphorylase
  ENSP ID: ENSP00000452421
MQRGLALSLVSGARRQSHAAASAGRDARGNRAGVAPPEQEGDRYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMG

SEQ ID NO: 69993 - protein, 399 aa, Homo sapiens
  Payload ID: 13898
  Gene Symbol: P2RX1
  Gene Name: purinergic receptor P2X, ligand gated ion channel, 1
  Uniprot ID: P51575
  ENSP ID: ENSP00000225538
MARRFQEELAAFLFEYDTPRMVLVRNKKVGVIFRLIQLVVLVYVIGWVFLYEKGYQTSSGLISSVSVKLKGLAVTQLPGLGPQVWDVADYVFPAQGDNSFVVMTNFIVTPKQTQGYCAEHPEGGICKEDSGCTPGKAKRKAQGIRTGKCVAFNDTVKTCEIFGWCPVEVDDDIPRPALLREAENFTLFIKNSISFPRFKVNRRNLVEEVNAAHMKTCLFHKTLHPLCPVFQLGYVVQESGQNFSTLAEKGGVVGITIDWHCDLDWHVRHCRPIYEFHGLYEEKNLSPGFNFRFARHFVENGTNYRHLFKVFGIRFDILVDGKAGKFDIIPTMTTIGSGIGIFGVATVLCDLLLLHILPKRHYYKQKKFKYAEDMGPGAAERDLAATSSTLGLQENMRTS

SEQ ID NO: 69994 - protein, 57 aa, Homo sapiens
  Payload ID: 13898
  Gene Symbol: P2RX1
  Gene Name: purinergic receptor P2X, ligand gated ion channel, 1
  ENSP ID: ENSP00000460449
MARRFQEELAAFLFEYDTPRMVLVRNKKVGVIFRLIQLVVLVYVIGGRPSWQATVRE

SEQ ID NO: 69995 - protein, 399 aa, Homo sapiens
  Payload ID: 13899
  Gene Symbol: P2RX2
  Gene Name: purinergic receptor P2X, ligand gated ion channel, 2
  Uniprot ID: Q9UBL9
  ENSP ID: ENSP00000341419
MAAAQPKYPAGATARRLARGCWSALWDYETPKVIVVRIHRAEKLPGERDGPRELHHHQGQGDHHVRAQSVGRGGVREAPRGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 69996 - protein, 497 aa, Homo sapiens
  Payload ID: 13899
  Gene Symbol: P2RX2
  Gene Name: purinergic receptor P2X, ligand gated ion channel, 2
  Uniprot ID: Q9UBL9
  ENSP ID: ENSP00000343339
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVVRNPLWGPSGCGGSTRPLHTGLCWPQGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 69997 - protein, 447 aa, Homo sapiens
  Payload ID: 13899
  Gene Symbol: P2RX2
  Gene Name: purinergic receptor P2X, ligand gated ion channel, 2
  Uniprot ID: Q9UBL9
  ENSP ID: ENSP00000343904
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 69998 - protein, 379 aa, Homo sapiens
  Payload ID: 13899
  Gene Symbol: P2RX2
  Gene Name: purinergic receptor P2X, ligand gated ion channel, 2
  Uniprot ID: Q9UBL9
  ENSP ID: ENSP00000344502
MAAAQPKYPAGATARRLARGCWSALWDYETPKVIVSIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 69999 - protein, 404 aa, Homo sapiens
  Payload ID: 13899
  Gene Symbol: P2RX2
  Gene Name: purinergic receptor P2X, ligand gated ion channel, 2
  Uniprot ID: Q9UBL9
  ENSP ID: ENSP00000345095
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKMVDTPASEPAQASTPTDPKGLAQL

SEQ ID NO: 70000 - protein, 471 aa, Homo sapiens
  Payload ID: 13899
  Gene Symbol: P2RX2
  Gene Name: purinergic receptor P2X, ligand gated ion channel, 2
  Uniprot ID: Q9UBL9
  ENSP ID: ENSP00000373762
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 70001 - protein, 370 aa, Homo sapiens
  Payload ID: 13899
  Gene Symbol: P2RX2
  Gene Name: purinergic receptor P2X, ligand gated ion channel, 2
  Uniprot ID: Q9UBL9
  ENSP ID: ENSP00000405531
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPESIRVHNATCLSDADCVAGELDMLGNGALQDLRGVRLVPGGRWGLCQPISGYDGPKFHHPHQEQHPLPQIPLLQGQHRRPHRRVPEALHVPRGLRPLLPHLQAGLYRGEGWGELHRARTQGRGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKMVDTPASEPAQASTPTDPKGLAQL

SEQ ID NO: 70002 - protein, 349 aa, Homo sapiens
  Payload ID: 13899
  Gene Symbol: P2RX2
  Gene Name: purinergic receptor P2X, ligand gated ion channel, 2
  ENSP ID: ENSP00000444477
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQVPAPAGGREVQPDSHHY

SEQ ID NO: 70003 - protein, 397 aa, Homo sapiens
  Payload ID: 13900
  Gene Symbol: P2RX3
  Gene Name: purinergic receptor P2X, ligand gated ion channel, 3
  Uniprot ID: P56373
  ENSP ID: ENSP00000263314
MNCISDFFTYETTKSVVVKSWTIGIINRVVQLLIISYFVGWVFLHEKAYQVRDTAIESSVVTKVKGSGLYANRVMDVSDYVTPPQGTSVFVIITKMIVTENQMQGFCPESEEKYRCVSDSQCGPERLPGGGILTGRCVNYSSVLRTCEIQGWCPTEVDTVETPIMMEAENFTIFIKNSIRFPLFNFEKGNLLPNLTARDMKTCRFHPDKDPFCPILRVGDVVKFAGQDFAKLARTGGVLGIKIGWVCDLDKAWDQCIPKYSFTRLDSVSEKSSVSPGYNFRFAKYYKMENGSEYRTLLKAFGIRFDVLVYGNAGKFNIIPTIISSVAAFTSVGVGTVLCDIILLNFLKGADQYKAKKFEEVNETTLKIAALTNPVYPSDQTTAEKQSTDSGAFSIGH

SEQ ID NO: 70004 - protein, 50 aa, Homo sapiens
  Payload ID: 13900
  Gene Symbol: P2RX3
  Gene Name: purinergic receptor P2X, ligand gated ion channel, 3
  ENSP ID: ENSP00000434166
KYRCVSDSQCGPERLPGGGILTGRCVNYSSVLRTCEIQGWCPTEVDTVET

SEQ ID NO: 70005 - protein, 396 aa, Homo sapiens [sequence omitted]

SEQ ID NO: 70006 - protein, 388 aa, Homo sapiens
  Payload ID: 13901
  Gene Symbol: P2RX4
  Gene Name: purinergic receptor P2X, ligand gated ion channel, 4
  Uniprot ID: Q99571
  ENSP ID: ENSP00000336607
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 70007 - protein, 404 aa, Homo sapiens
  Payload ID: 13901
  Gene Symbol: P2RX4
  Gene Name: purinergic receptor P2X, ligand gated ion channel, 4
  Uniprot ID: Q99571
  ENSP ID: ENSP00000353032
MAGCCAALAAFLFEYDTPRIVLIRSRKVGLMNRAVQLLILAYVIGCYHPHLAEVEMESPRRWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 70008 - protein, 123 aa, Homo sapiens
  Payload ID: 13901
  Gene Symbol: P2RX4
  Gene Name: purinergic receptor P2X, ligand gated ion channel, 4
  ENSP ID: ENSP00000437396
  MOD_RES (1)..(1): Any amino acid
XSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNDLLF

SEQ ID NO: 70009 - protein, 341 aa, Homo sapiens
  Payload ID: 13901
  Gene Symbol: P2RX4
  Gene Name: purinergic receptor P2X, ligand gated ion channel, 4
  ENSP ID: ENSP00000438131
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPKKFLESD

SEQ ID NO: 70010 - protein, 361 aa, Homo sapiens
  Payload ID: 13901
  Gene Symbol: P2RX4
  Gene Name: purinergic receptor P2X, ligand gated ion channel, 4
  Uniprot ID: Q99571
  ENSP ID: ENSP00000438329
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 70011 - protein, 52 aa, Homo sapiens
  Payload ID: 13901
  Gene Symbol: P2RX4
  Gene Name: purinergic receptor P2X, ligand gated ion channel, 4
  ENSP ID: ENSP00000439386
MAGCCAALAAFLFEYDTPRIVLIRSRKVGLMNRAVQLLILAYVIGRKTPSSS

SEQ ID NO: 70012 - protein, 145 aa, Homo sapiens
  Payload ID: 13901
  Gene Symbol: P2RX4
  Gene Name: purinergic receptor P2X, ligand gated ion channel, 4
  ENSP ID: ENSP00000444033
MAGCCAALAAFLFEYDTPRIVLIRSRKVGLMNRAVQLLILAYVIGPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYS

SEQ ID NO: 70013 - protein, 148 aa, Homo sapiens
  Payload ID: 13901
  Gene Symbol: P2RX4
  Gene Name: purinergic receptor P2X, ligand gated ion channel, 4
  ENSP ID: ENSP00000444274
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNAWHHPG

SEQ ID NO: 70014 - protein, 422 aa, Homo sapiens
  Payload ID: 13902
  Gene Symbol: P2RX5
  Gene Name: purinergic receptor P2X, ligand gated ion channel, 5
  Uniprot ID: Q93086
  ENSP ID: ENSP00000225328
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 70015 - protein, 398 aa, Homo sapiens
  Payload ID: 13902
  Gene Symbol: P2RX5
  Gene Name: purinergic receptor P2X, ligand gated ion channel, 5
  Uniprot ID: Q93086
  ENSP ID: ENSP00000342161
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQNEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 70016 - protein, 397 aa, Homo sapiens
  Payload ID: 13902
  Gene Symbol: P2RX5
  Gene Name: purinergic receptor P2X, ligand gated ion channel, 5
  Uniprot ID: Q93086
  ENSP ID: ENSP00000447545
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQNEGIPDGACSKDSDCHAGEAVTAGNGVKTGRCLRRENLARGTCEIFAWCPLETSSRPEEPFLKEAEDFTIFIKNHIRFPKFNFSNNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 70017 - protein, 29 aa, Homo sapiens
  Payload ID: 13902
  Gene Symbol: P2RX5
  Gene Name: purinergic receptor P2X, ligand gated ion channel, 5
  ENSP ID: ENSP00000447815
  MOD_RES (1)..(1): Any amino acid
XRFDVMVNGKGPRRQFPGGRGRGIGAGAI

SEQ ID NO: 70018 - protein, 421 aa, Homo sapiens
  Payload ID: 13902
  Gene Symbol: P2RX5
  Gene Name: purinergic receptor P2X, ligand gated ion channel, 5
  Uniprot ID: Q93086
  ENSP ID: ENSP00000448355
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSNNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 70019 - protein, 286 aa, Homo sapiens
  Payload ID: 13902
  Gene Symbol: P2RX5
  Gene Name: purinergic receptor P2X, ligand gated ion channel, 5
  ENSP ID: ENSP00000449495
  MOD_RES (1)..(1): Any amino acid
XGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSNRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVC

SEQ ID NO: 70020 - protein, 362 aa, Homo sapiens
  Payload ID: 13902
  Gene Symbol: P2RX5
  Gene Name: purinergic receptor P2X, ligand gated ion channel, 5
  ENSP ID: ENSP00000450006
MPTYRPPSHRWVFLIKKGYQDVDTSLQSAVITKVKGVAFTNTSDLGQRIWDVADYVIPAQNEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 70021 - protein, 431 aa, Homo sapiens
  Payload ID: 13902
  Gene Symbol: P2RX5
  Gene Name: purinergic receptor P2X, ligand gated ion channel, 5
  ENSP ID: ENSP00000467707
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSNNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRLRTPSASPLHQE

SEQ ID NO: 70022 - protein, 415 aa, Homo sapiens
  Payload ID: 13903
  Gene Symbol: P2RX6
  Gene Name: purinergic receptor P2X, ligand gated ion channel, 6
  Uniprot ID: O15547
  ENSP ID: ENSP00000385309
MCPQLAGAGSMGSPGATTGWGLLDYKTEKWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 70023 - protein, 120 aa, Homo sapiens
  Payload ID: 13903
  Gene Symbol: P2RX6
  Gene Name: purinergic receptor P2X, ligand gated ion channel, 6
  ENSP ID: ENSP00000398347
  MOD_RES (1)..(1): Any amino acid
XQLAGAGSMGSPGATTGWGLLDYKTEKYVMTRNWRVGALQRLLQFGIVVYVVGWALLAKKGYQERDLEPQFSIITKLKGVSVTQIKELGNRLWDVADFVKPPQAAGFRPFQSTRAQPGQP

SEQ ID NO: 70024 - protein, 80 aa, Homo sapiens
  Payload ID: 13903
  Gene Symbol: P2RX6
  Gene Name: purinergic receptor P2X, ligand gated ion channel, 6
  ENSP ID: ENSP00000401192
MCPQLAGAGSMGSPGATTGWGLLDYKTEKWALLAKKGYQERDLEPQFSIITKLKGVSVTQIKELGNRLWDVADFVKPPQV

SEQ ID NO: 70025 - protein, 130 aa, Homo sapiens
  Payload ID: 13903
  Gene Symbol: P2RX6
  Gene Name: purinergic receptor P2X, ligand gated ion channel, 6
  ENSP ID: ENSP00000404223
LAGAGSMGSPGATTGWGLLDYKTEKYVMTRNWRVGALQRLLQFGIVVYVVGSPRQKRLPGAGPGTPVFHHHQTQRGFRHSDQGAWKPAVGCGRLREATSGRERVLLGDQLPCDASPSSGQMPRAPVRPTG

SEQ ID NO: 70026 - protein, 101 aa, Homo sapiens
  Payload ID: 13903
  Gene Symbol: P2RX6
  Gene Name: purinergic receptor P2X, ligand gated ion channel, 6
  ENSP ID: ENSP00000407920
AGAGSMGSPGATTGWGLLDYKTEKYVMTRNWRVGALQRLLQFGIVVYVVGWALLAKKGYQERDLEPQFSIITKLKGVSVTQIKELGNRLWDVADFVKPPQV

SEQ ID NO: 70027 - protein, 441 aa, Homo sapiens
  Payload ID: 13903
  Gene Symbol: P2RX6
  Gene Name: purinergic receptor P2X, ligand gated ion channel, 6
  Uniprot ID: O15547
  ENSP ID: ENSP00000416193
MCPQLAGAGSMGSPGATTGWGLLDYKTEKYVMTRNWRVGALQRLLQFGIVVYVVGWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 70028 - protein, 149 aa, Homo sapiens
  Payload ID: 13904
  Gene Symbol: P2RX7
  Gene Name: purinergic receptor P2X, ligand gated ion channel, 7
  ENSP ID: ENSP00000261826
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGLLS

SEQ ID NO: 70029 - protein, 595 aa, Homo sapiens
  Payload ID: 13904
  Gene Symbol: P2RX7
  Gene Name: purinergic receptor P2X, ligand gated ion channel, 7
  Uniprot ID: Q99572
  ENSP ID: ENSP00000330696
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFAILPSCCRWRIRKEFPKSEGQYSGFKSPY

SEQ ID NO: 70030 - protein, 128 aa, Homo sapiens
  Payload ID: 13904
  Gene Symbol: P2RX7
  Gene Name: purinergic receptor P2X, ligand gated ion channel, 7
  Uniprot ID: Q99572
  ENSP ID: ENSP00000437729
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEEFRPEGV

SEQ ID NO: 70031 - protein, 47 aa, Homo sapiens
  Payload ID: 13904
  Gene Symbol: P2RX7
  Gene Name: purinergic receptor P2X, ligand gated ion channel, 7
  ENSP ID: ENSP00000438586
MPACCSCSDVFQYETNKVTRIQSMNYGTIKWFFHVIIFSYVWGTLSS

SEQ ID NO: 70032 - protein, 127 aa, Homo sapiens
  Payload ID: 13904
  Gene Symbol: P2RX7
  Gene Name: purinergic receptor P2X, ligand gated ion channel, 7
  ENSP ID: ENSP00000439247
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQLFRRTATKPARSAEIQKDRELSTKEHQPF

SEQ ID NO: 70033 - protein, 47 aa, Homo sapiens; identical to SEQ ID NO: 70031
  Payload ID: 13904
  Gene Symbol: P2RX7
  Gene Name: purinergic receptor P2X, ligand gated ion channel, 7
  ENSP ID: ENSP00000439961

SEQ ID NO: 70034 - protein, 128 aa, Homo sapiens; identical to SEQ ID NO: 70030
  Payload ID: 13904
  Gene Symbol: P2RX7
  Gene Name: purinergic receptor P2X, ligand gated ion channel, 7
  Uniprot ID: Q99572
  ENSP ID: ENSP00000441230

SEQ ID NO: 70035 - protein, 275 aa, Homo sapiens
  Payload ID: 13904
  Gene Symbol: P2RX7
  Gene Name: purinergic receptor P2X, ligand gated ion channel, 7
  Uniprot ID: Q99572
  ENSP ID: ENSP00000442470
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTYAKYYKENNVEKRTLIKVFGIRFDILVFGTGGKFDIIQLVVYIGSTLSYFGLVRDSLFHALGKWFGEGSD

SEQ ID NO: 70036 - protein, 364 aa, Homo sapiens
  Payload ID: 13904
  Gene Symbol: P2RX7
  Gene Name: purinergic receptor P2X, ligand gated ion channel, 7
  Uniprot ID: Q99572
  ENSP ID: ENSP00000442572
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLVRDSLFHALGKWFGEGSD

SEQ ID NO: 70037 - protein, 258 aa, Homo sapiens
  Payload ID: 13904
  Gene Symbol: P2RX7
  Gene Name: purinergic receptor P2X, ligand gated ion channel, 7
  ENSP ID: ENSP00000443640
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQIRQVLQGKQC

SEQ ID NO: 70038 - protein, 127 aa, Homo sapiens; identical to SEQ ID NO: 70032
  Payload ID: 13904
  Gene Symbol: P2RX7
  Gene Name: purinergic receptor P2X, ligand gated ion channel, 7
  ENSP ID: ENSP00000445325

SEQ ID NO: 70039 - protein, 47 aa, Homo sapiens; identical to SEQ ID NO: 70031
  Payload ID: 13904
  Gene Symbol: P2RX7
  Gene Name: purinergic receptor P2X, ligand gated ion channel, 7
  ENSP ID: ENSP00000445564

SEQ ID NO: 70040 - protein, 373 aa, Homo sapiens
  Payload ID: 13905
  Gene Symbol: P2RY1
  Gene Name: purinergic receptor P2Y, G-protein coupled, 1
  Uniprot ID: P47900
  ENSP ID: ENSP00000304767
MTEVLWPAVPNGTDAAFLAGPGSSWGNSTVASTAAVSSSFKCALTKTGFQFYYLPAVYILVFIIGFLGNSVAIWMFVFHMKPWSGISVYMFNLALADFLYVLTLPALIFYYFNKTDWIFGDAMCKLQRFIFHVNLYGSILFLTCISAHRYSGVVYPLKSLGRLKKKNAICISVLVWLIVVVAISPILFYSGTGVRKNKTITCYDTTSDEYLRSYFIYSMCTTVAMFCVPLVLILGCYGLIVRALIYKDLDNSPLRRKSIYLVIIVLTVFAVSYIPFHVMKTMNLRARLDFQTPAMCAFNDRVYATYQVTRGLASLNSCVDPILYFLAGDTFRRRLSRATRKASRRSEANLQSKSEDMTLNILPEFKQNGDTSL

SEQ ID NO: 70041 - protein, 339 aa, Homo sapiens
  Payload ID: 13906
  Gene Symbol: P2RY10
  Gene Name: purinergic receptor P2Y, G-protein coupled, 10
  Uniprot ID: O00398
  ENSP ID: ENSP00000171757
MANLDKYTETFKMGSNSTSTAEIYCNVTNVKFQYSLYATTYILIFIPGLLANSAALWVLCRFISKKNKAIIFMINLSVADLAHVLSLPLRIYYYISHHWPFQRALCLLCFYLKYLNMYASICFLTCISLQRCFFLLKPFRARDWKRRYDVGISAAIWIVVGTACLPFPILRSTDLNNNKSCFADLGYKQMNAVALVGMITVAELAGFVIPVIIIAWCTWKTTISLRQPPMAFQGISERQKALRMVFMCAAVFFICFTPYHINFIFYTMVKETIISSCPVVRIALYFHPFCLCLASLCCLLDPILYYFMASEFRDQLSRHGSSVTRSRLMSKESGSSMIG

SEQ ID NO: 70042 - protein, 339 aa, Homo sapiens; identical to SEQ ID NO: 70041
  Payload ID: 13906
  Gene Symbol: P2RY10
  Gene Name: purinergic receptor P2Y, G-protein coupled, 10
  Uniprot ID: O00398
  ENSP ID: ENSP00000443138

SEQ ID NO: 70043 - protein, 374 aa, Homo sapiens
  Payload ID: 13907
  Gene Symbol: P2RY11
  Gene Name: purinergic receptor P2Y, G-protein coupled, 11
  Uniprot ID: Q96G91
  ENSP ID: ENSP00000323872
MAANVSGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 70044 - protein, 342 aa, Homo sapiens
  Payload ID: 13908
  Gene Symbol: P2RY12
  Gene Name: purinergic receptor P2Y, G-protein coupled, 12
  Uniprot ID: Q9H244
  ENSP ID: ENSP00000307259
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPKNLLGAKILSVVIWAFMFLLSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 70045 - protein, 354 aa, Homo sapiens
  Payload ID: 13909
  Gene Symbol: P2RY13
  Gene Name: purinergic receptor P2Y, G-protein coupled, 13
  Uniprot ID: Q9BPV8
  ENSP ID: ENSP00000320376
MTAAIRRQRELSILPKVTLEAMNTTVMQGFNRSERCPRDTRIVQLVFPALYTVVFLTGILLNTLALWVFVHIPSSSTFIIYLKNTLVADLIMTLMLPFKILSDSHLAPWQLRAFVCRFSSVIFYETMYVGIVLLGLIAFDRFLKIIRPLRNIFLKKPVFAKTVSIFIWFFLFFISLPNTILSNKEATPSSVKKCASLKGPLGLKWHQMVNNICQFIFWTVFILMLVFYVVIAKKVYDSYRKSKSKDRKNNKKLEGKVFVVVAVFFVCFAPFHFARVPYTHSQTNNKTDCRLQNQLFIAKETTLFLAATNICMDPLIYIFLCKKFTEKLPCMQGRKTTASSQENHSSQTDNITLG

SEQ ID NO: 70046 - protein, 338 aa, Homo sapiens
  Payload ID: 13910
  Gene Symbol: P2RY14
  Gene Name: purinergic receptor P2Y, G-protein coupled, 14
  Uniprot ID: Q15391
  ENSP ID: ENSP00000308361
MINSTSTQPPDESCSQNLLITQQIIPVLYCMVFIAGILLNGVSGWIFFYVPSSKSFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 70047 - protein, 338 aa, Homo sapiens; identical to SEQ ID NO: 70046
  Payload ID: 13910
  Gene Symbol: P2RY14
  Gene Name: purinergic receptor P2Y, G-protein coupled, 14
  Uniprot ID: Q15391
  ENSP ID: ENSP00000408733

SEQ ID NO: 70048 - protein, 95 aa, Homo sapiens
  Payload ID: 13910
  Gene Symbol: P2RY14
  Gene Name: purinergic receptor P2Y, G-protein coupled, 14
  ENSP ID: ENSP00000418065
MINSTSTQPPDESCSQNLLITQQIIPVLYCMVFIAGILLNGVSGWIFFYVPSSKSFIIYLKNIVIADFVMSLTFPFKILGDSGLGPWQLNVFVCR

SEQ ID NO: 70049 - protein, 377 aa, Homo sapiens
  Payload ID: 13911
  Gene Symbol: P2RY2
  Gene Name: purinergic receptor P2Y, G-protein coupled, 2
  Uniprot ID: P41231
  ENSP ID: ENSP00000310305
MAADLGPWNDTINGTWDGDELGYRCRFNEDFKYVLLPVSYGVVCVPGLCLNAVALYIFLCRLKTWNASTTYMFHLAVSDALYAASLPLLVYYYARGDHWPFSTVLCKLVRFLFYTNLYCSILFLTCISVHRCLGVLRPLRSLRWGRARYARRVAGAVWVLVLACQAPVLYFVTTSARGGRVTCHDTSAPELFSRFVAYSSVMLGLLFAVPFAVILVCYVLMARRLLKPAYGTSGGLPRAKRKSVRTIAVVLAVFALCFLPFHVTRTLYYSFRSLDLSCHTLNAINMAYKVTRPLASANSCLDPVLYFLAGQRLVRFARDAKPPTGPSPATPARRRLGLRRSDRTDMQRIEDVLGSSEDSRRTESTPAGSENTKDIRL

SEQ ID NO: 70050 - protein, 377 aa, Homo sapiens; identical to SEQ ID NO: 70049
  Payload ID: 13911
  Gene Symbol: P2RY2
  Gene Name: purinergic receptor P2Y, G-protein coupled, 2
  Uniprot ID: P41231
  ENSP ID: ENSP00000377221

SEQ ID NO: 70051 - protein, 377 aa, Homo sapiens; identical to SEQ ID NO: 70049
  Payload ID: 13911
  Gene Symbol: P2RY2
  Gene Name: purinergic receptor P2Y, G-protein coupled, 2
  Uniprot ID: P41231
  ENSP ID: ENSP00000377222

SEQ ID NO: 70052 - protein, 359 aa, Homo sapiens
  Payload ID: 13912
  Gene Symbol: P2RY8
  Gene Name: purinergic receptor P2Y, G-protein coupled, 8
  Uniprot ID: Q86VZ1
  ENSP ID: ENSP00000370697
MQVPNSTGPDNATLQMLRNPAIAVALPVVYSLVAAVSIPGNLFSLWVLCRRMGPRSPSVIFMINLSVTDLMLASVLPFQIYYHCNRHHWVFGVLLCNVVTVAFYANMYSSILTMTCISVERFLGVLYPLSSKRWRRRRYAVAACAGTWLLLLTALSPLARTDLTYPVHALGIITCFDVLKWTMLPSVAMWAVFLFTIFILLFLIPFVITVACYTATILKLLRTEEAHGREQRRRAVGLAAVVLLAFVTCFAPNNFVLLAHIVSRLFYGKSYYHVYKLTLCLSCLNNCLDPFVYYFASREFQLRLREYLGCRRVPRDTLDTRRESLFSARTTSVRSEAGAHPEGMEGATRPGLQRQESVF

SEQ ID NO: 70053 - protein, 322 aa, Homo sapiens
  Payload ID: 13913
  Gene Symbol: PURA
  Gene Name: purine-rich element binding protein A
  Uniprot ID: Q00577
  ENSP ID: ENSP00000332706
MADRDSGSEQGGAALGSGGSLGHPGSGSGSGGGGGGGGGGGGSGGGGGGAPGGLQHETQELASKRVDIQNKRFYLDVKQNAKGRFLKIAEVGAGGNKSRLTLSMSVAVEFRDYLGDFIEHYAQLGPSQPPDLAQAQDEPRRALKSEFLVRENRKYYMDLKENQRGRFLRIRQTVNRGPGLGSTQGQTIALPAQGLIEFRDALAKLIDDYGVEEEPAELPEGTSLTVDNKRFFFDVGSNKYGVFMRVSEVKPTYRNSITVPYKVWAKFGHTFCKYSEEMKKIQEKQREKRAACEQLHQQQQQQQEETAAATLLLQGEEEGEED

SEQ ID NO: 70054 - protein, 312 aa, Homo sapiens
  Payload ID: 13914
  Gene Symbol: PURB
  Gene Name: purine-rich element binding protein B
  Uniprot ID: Q96QR8
  ENSP ID: ENSP00000379051
MADGDSGSERGGGGGPCGFQPASRGGGEQETQELASKRLDIQNKRFYLDVKQNAKGRFLKIAEVGAGGSKSRLTLSMAVAAEFRDSLGDFIEHYAQLGPSSPEQLAAGAEEGGGPRRALKSEFLVRENRKYYLDLKENQRGRFLRIRQTVNRGGGGFGAGPGPGGLQSGQTIALPAQGLIEFRDALAKLIDDYGGEDDELAGGPGGGAGGPGGGLYGELPEGTSITVDSKRFFFDVGCNKYGVFLRVSEVKPSYRNAITVPFKAWGKFGGAFCRYADEMKEIQERQRDKLYERRGGGSGGGEESEGEEVDED

SEQ ID NO: 70055 - protein, 322 aa, Homo sapiens
  Payload ID: 13915
  Gene Symbol: PURG
  Gene Name: purine-rich element binding protein G
  Uniprot ID: Q9UJV8
  ENSP ID: ENSP00000345168
MERARRRGGGGGRGRGGKNVGGSGLSKSRLYPQAQHSHYPHYAASATPNQAGGAAEIQELASKRVDIQKKRFYLDVKQSSRGRFLKIAEVWIGRGRQDNIRKSKLTLSLSVAAELKDCLGDFIEHYAHLGLKGHRQEHGHSKEQGSRRRQKHSAPSPPVSVGSEEHPHSVLKTDYIERDNRKYYLDLKENQRGRFLRIRQTMMRGTGMIGYFGHSLGQEQTIVLPAQGMIEFRDALVQLIEDYGEGDIEERRGGDDDPLELPEGTSFRVDNKRFYFDVGSNKYGIFLKLTNYPKSRENINLFHCCQIKHKEQPHDTTKTVEE

SEQ ID NO: 70056 - protein, 347 aa, Homo sapiens
  Payload ID: 13915
  Gene Symbol: PURG
  Gene Name: purine-rich element binding protein G
  Uniprot ID: Q9UJV8
  ENSP ID: ENSP00000418721
MERARRRGGGGGRGRGGKNVGGSGLSKSRLYPQAQHSHYPHYAASATPNQAGGAAEIQELASKRVDIQKKRFYLDVKQSSRGRFLKIAEVWIGRGRQDNIRKSKLTLSLSVAAELKDCLGDFIEHYAHLGLKGHRQEHGHSKEQGSRRRQKHSAPSPPVSVGSEEHPHSVLKTDYIERDNRKYYLDLKENQRGRFLRIRQTMMRGTGMIGYFGHSLGQEQTIVLPAQGMIEFRDALVQLIEDYGEGDIEERRGGDDDPLELPEGTSFRVDNKRFYFDVGSNKYGIFLKVSEVRPPYRNTITVPFKAWTRFGENFIKYEEEMRKICNSHKEKRMDGRKASGEEQECLD

SEQ ID NO: 70057 - protein, 163 aa, Homo sapiens
  Payload ID: 13915
  Gene Symbol: PURG
  Gene Name: purine-rich element binding protein G
  ENSP ID: ENSP00000466881
MERARRRGGGGGRGRGGKNVGGSGLSKSRLYPQAQHSHYPHYAASATPNQAGGAAEIQELASKRVDIQKKRFYLDVKQSSRGRFLKIAEVWIGRGRQDNIRKSKLTLSLSVAAELKDCLGDFIEHYAHLGLKGHRQEHGHSKEQGSRRRQKHSAPSPPVSVGS

SEQ ID NO: 70058 - protein, 136 aa, Homo sapiens
  Payload ID: 13916
  Gene Symbol: PCP2
  Gene Name: Purkinje cell protein 2
  Uniprot ID: Q8IVA1
  ENSP ID: ENSP00000310585
MMDQEEKTEEGSGPCAEAGSPDQEGFFNLLSHVQGDRMEGQRCSLQAGPGQTTKSQSDPTPEMDSLMDMLASTQGRRMDDQRVTVSSLPGFQPVGSKDGAQKRAGTLSPQPLLTPQDPTALGFRRNSSPQPPTQAP

SEQ ID NO: 70059 - protein, 120 aa, Homo sapiens
  Payload ID: 13916
  Gene Symbol: PCP2
  Gene Name: Purkinje cell protein 2
  Uniprot ID: Q8IVA1
  ENSP ID: ENSP00000472761
MAGSPDQEGFFNLLSHVQGDRMEGQRCSLQAGPGQTTKSQSDPTPEMDSLMDMLASTQGRRMDDQRVTVSSLPGFQPVGSKDGAQKRAGTLSPQPLLTPQDPTALGFRRNSSPQPPTQAP

SEQ ID NO: 70060 - protein, 62 aa, Homo sapiens
  Payload ID: 13917
  Gene Symbol: PCP4
  Gene Name: Purkinje cell protein 4
  Uniprot ID: P48539
  ENSP ID: ENSP00000329403
MSERQGAGATNGKDKTSGENDGQKKVQEEFDIDMDAPETERAAVAIQSQFRKFQKKKAGSQS

SEQ ID NO: 70061 - protein, 31 aa, Homo sapiens
  Payload ID: 13917
  Gene Symbol: PCP4
  Gene Name: Purkinje cell protein 4
  ENSP ID: ENSP00000433172
MSERQGAGATNGKDKTSGENVGCPILFLTHS

SEQ ID NO: 70062 - protein, 68 aa, Homo sapiens
  Payload ID: 13918
  Gene Symbol: PCP4L1
  Gene Name: Purkinje cell protein 4 like 1
  Uniprot ID: A6NKN8
  ENSP ID: ENSP00000426296
MSELNTKTSPATNQAAGQEEKGKAGNVKKAEEEEEIDIDLTAPETEKAALAIQGKFRRFQKRKKDPSS

SEQ ID NO: 70063 - protein, 466 aa, Homo sapiens
  Payload ID: 13919
  Gene Symbol:
  Gene Name: Putative eukaryotic translation initiation factor 2 subunit 3-like protein  [Source:UniProtKB/Swiss-Prot
  Acc:Q2VIR3]
  ENSP ID: ENSP00000323063
MAGGEAGVTLGQPHLSRQDLTTLDVTKLTPLSHEVISRQATINIGTIGHVAHGKSTVVKAISGVHTVRFKNELERNITIKLGYANAKIYQLDDPSCPRPECYRSCGSSMPDEFPTDIPGTKGNFRLVRHVSFVDCPGHDILMATMLNGAAVMDAALLLIAGNESCPQPQTSEHLAAIEIMKLKHILILQNKIDLVKERQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQETEVRPGIVSKDSEGKLMCKSIFSKIVSLFAEHNDLQYAAPGGLIGVGTKIDPTLCRADRMVGQILGAVGALPEIFTELEISYFLLRRLLGVRTEGDKKAAKVQKLSKNEVLMVNIGSLSTGGRVSAVKADLGKIVLTNPVCTEIHLIHLDLIKELEWGPVLTNETQRKSAANF

SEQ ID NO: 70064 - protein, 472 aa, Homo sapiens
  Payload ID: 13919
  Gene Symbol:
  Gene Name: Putative eukaryotic translation initiation factor 2 subunit 3-like protein  [Source:UniProtKB/Swiss-Prot
  Acc:Q2VIR3]
  Uniprot ID: Q2VIR3
  ENSP ID: ENSP00000445077
MAGGEAGVTLGQPHLSRQDLTTLDVTKLTPLSHEVISRQATINIGTIGHVAHGKSTVVKAISGVHTVRFKNELERNITIKLGYANAKIYQLDDPSCPRPECYRSCGSSMPDEFPTDIPGTKGNFRLVRHVSFVDCPGHDILMATMLNGAAVMDAALLLIAGNESCPQPQTSEHLAAIEIMKLKHILILQNKIDLVKERQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQETEVRPGIVSKDSEGKLMCKSIFSKIVSLFAEHNDLQYAAPGGLIGVGTKIDPTLCRADRMVGQILGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 70065 - protein, 637 aa, Homo sapiens
  Payload ID: 13920
  Gene Symbol: PHTF1
  Gene Name: putative homeodomain transcription factor 1
  Uniprot ID: Q9UMS5
  ENSP ID: ENSP00000350428
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVKVSHLL

SEQ ID NO: 70066 - protein, 717 aa, Homo sapiens
  Payload ID: 13920
  Gene Symbol: PHTF1
  Gene Name: putative homeodomain transcription factor 1
  ENSP ID: ENSP00000358611
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 70067 - protein, 709 aa, Homo sapiens
  Payload ID: 13920
  Gene Symbol: PHTF1
  Gene Name: putative homeodomain transcription factor 1
  ENSP ID: ENSP00000358613
MASNERDAISWYQKKIGAYDQQIWEKSIEQTQIKGLKNKPKKMGHIKPDLIDVDLIRVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 70068 - protein, 762 aa, Homo sapiens
  Payload ID: 13920
  Gene Symbol: PHTF1
  Gene Name: putative homeodomain transcription factor 1
  Uniprot ID: Q9UMS5
  ENSP ID: ENSP00000358617
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 70069 - protein, 762 aa, Homo sapiens; identical to SEQ ID NO: 70068
  Payload ID: 13920
  Gene Symbol: PHTF1
  Gene Name: putative homeodomain transcription factor 1
  Uniprot ID: Q9UMS5
  ENSP ID: ENSP00000377025

SEQ ID NO: 70070 - protein, 105 aa, Homo sapiens
  Payload ID: 13920
  Gene Symbol: PHTF1
  Gene Name: putative homeodomain transcription factor 1
  ENSP ID: ENSP00000404690
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLL

SEQ ID NO: 70071 - protein, 331 aa, Homo sapiens
  Payload ID: 13920
  Gene Symbol: PHTF1
  Gene Name: putative homeodomain transcription factor 1
  ENSP ID: ENSP00000416810
  MOD_RES (1)..(1): Any amino acid
XQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQVSGEIRKIFYLFLYMIFH

SEQ ID NO: 70072 - protein, 785 aa, Homo sapiens
  Payload ID: 13921
  Gene Symbol: PHTF2
  Gene Name: putative homeodomain transcription factor 2
  Uniprot ID: Q8N3S3
  ENSP ID: ENSP00000248550
MASKVTDAIVWYQKKEFLSVATTAPGPQQVLPGYCQCSLKDQGLFIQCLIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 70073 - protein, 695 aa, Homo sapiens
  Payload ID: 13921
  Gene Symbol: PHTF2
  Gene Name: putative homeodomain transcription factor 2
  Uniprot ID: Q8N3S3
  ENSP ID: ENSP00000275575
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQINLYLKMEKKPNKKEELTLVNNVLKLATKLLKELDSPFRLYGLTMNPLLYNITQVVILSAVSGVISDLLGFNLKLWKIKS

SEQ ID NO: 70074 - protein, 747 aa, Homo sapiens
  Payload ID: 13921
  Gene Symbol: PHTF2
  Gene Name: putative homeodomain transcription factor 2
  Uniprot ID: Q8N3S3
  ENSP ID: ENSP00000307699
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 70075 - protein, 356 aa, Homo sapiens
  Payload ID: 13921
  Gene Symbol: PHTF2
  Gene Name: putative homeodomain transcription factor 2
  Uniprot ID: Q8N3S3
  ENSP ID: ENSP00000387355
MASKVTDAIVWYQKKIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEVYTLSLSVYIRIYFICY

SEQ ID NO: 70076 - protein, 785 aa, Homo sapiens; identical to SEQ ID NO: 70072
  Payload ID: 13921
  Gene Symbol: PHTF2
  Gene Name: putative homeodomain transcription factor 2
  Uniprot ID: Q8N3S3
  ENSP ID: ENSP00000400958

SEQ ID NO: 70077 - protein, 751 aa, Homo sapiens
  Payload ID: 13921
  Gene Symbol: PHTF2
  Gene Name: putative homeodomain transcription factor 2
  Uniprot ID: Q8N3S3
  ENSP ID: ENSP00000403042
MASKVTDAIVWYQKKIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 70078 - protein, 546 aa, Homo sapiens
  Payload ID: 13921
  Gene Symbol: PHTF2
  Gene Name: putative homeodomain transcription factor 2
  Uniprot ID: Q8N3S3
  ENSP ID: ENSP00000403620
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQVGIM

SEQ ID NO: 70079 - protein, 352 aa, Homo sapiens
  Payload ID: 13921
  Gene Symbol: PHTF2
  Gene Name: putative homeodomain transcription factor 2
  Uniprot ID: Q8N3S3
  ENSP ID: ENSP00000408035
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEVYTLSLSVYIRIYFICY

SEQ ID NO: 70080 - protein, 1138 aa, Homo sapiens
  Payload ID: 13922
  Gene Symbol:
  Gene Name: Putative NPIP-like protein LOC613037  [Source:UniProtKB/Swiss-Prot
  Acc:A6NJU9]
  Uniprot ID: A6NJU9
  ENSP ID: ENSP00000429734
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECVLTPLPPSADDNLKTPPECVLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAFHPQRMIISRHLPSVSSLPFHPQLHSQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRRPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPKPKRRRVGDVEPSRKPKRRRAADVEPSSPEPKRRRVGDVEPSRKPKRRRAADVEPSSPEPKRRRLS

SEQ ID NO: 70081 - protein, 420 aa, Homo sapiens
  Payload ID: 13922
  Gene Symbol:
  Gene Name: Putative NPIP-like protein LOC613037  [Source:UniProtKB/Swiss-Prot
  Acc:A6NJU9]
  ENSP ID: ENSP00000444728
MAAAEHRHSSGLPYWPYLTAETLKNRMGHQPPPPTQQHSITDNSLSLKTPPECVLTPLPPSADDNLKTPPECVLTPLPPSADDNLKTPPECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPKPKRRRVGDVEPSRKPKRRRAADVEPSSPEPKRRRVGDVEPSRKPKRRRAADVEPSSPEPKRRRLS

SEQ ID NO: 70082 - protein, 68 aa, Homo sapiens; identical to SEQ ID NO: 58228
  Payload ID: 13922
  Gene Symbol:
  Gene Name: Putative NPIP-like protein LOC613037  [Source:UniProtKB/Swiss-Prot
  Acc:A6NJU9]
  ENSP ID: ENSP00000455364

SEQ ID NO: 70083 - protein, 84 aa, Homo sapiens
  Payload ID: 13922
  Gene Symbol:
  Gene Name: Putative NPIP-like protein LOC613037  [Source:UniProtKB/Swiss-Prot
  Acc:A6NJU9]
  ENSP ID: ENSP00000455945
MVKLSIVLTPQFLSHDQGQLTKELQQHVKSVTCPCEYLRKVINTLADHHHRGTDFGGSPWLHVIIAFPTSYKVVITLWIVYLWV

SEQ ID NO: 70084 - protein, 49 aa, Homo sapiens; identical to SEQ ID NO: 58201
  Payload ID: 13922
  Gene Symbol:
  Gene Name: Putative NPIP-like protein LOC613037  [Source:UniProtKB/Swiss-Prot
  Acc:A6NJU9]
  ENSP ID: ENSP00000456511

SEQ ID NO: 70085 - protein, 40 aa, Homo sapiens; identical to SEQ ID NO: 58208
  Payload ID: 13922
  Gene Symbol:
  Gene Name: Putative NPIP-like protein LOC613037  [Source:UniProtKB/Swiss-Prot
  Acc:A6NJU9]
  ENSP ID: ENSP00000457242

SEQ ID NO: 70086 - protein, 250 aa, Homo sapiens [sequence omitted]

SEQ ID NO: 70087 - protein, 397 aa, Homo sapiens
  Payload ID: 13923
  Gene Symbol:
  Gene Name: Putative NPIP-like protein LOC729978  [Source:UniProtKB/Swiss-Prot
  Acc:A6NJ64]
  Uniprot ID: A6NJ64
  ENSP ID: ENSP00000382101
MFCCLGYEWLSGGCKTWHSAWVINTLADHHHRGTDFGGSPWLRIIIAFPRSYKVVLTLWTVYLWLSFLKTIFQSENGHDVSTDVQQRARRSNRRRQEGLRSICMHTKKRVSSFPGNKIGLKDVITLRRHVETKGRAKIRKMKVTTKINHHDKINGKRKTAKKQKLSVKECEHAEKERQVSEAEENGKLDMKEIHTYMKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECLLTPLPPSAPPSADDNLKTPPLATQEAEAEKPPKPKRWRAAEMESPPEPKRRRAAEVESPPEPKRRRAAEVEPSSPEPKRRRLSKLRTGHCTQA

SEQ ID NO: 70088 - protein, 35 aa, Homo sapiens
  Payload ID: 13923
  Gene Symbol:
  Gene Name: Putative NPIP-like protein LOC729978  [Source:UniProtKB/Swiss-Prot
  Acc:A6NJ64]
  ENSP ID: ENSP00000442069
MKVTTKINHHDKINGKRKTAKKQKLSVKECEHAEK

SEQ ID NO: 70089 - protein, 307 aa, Homo sapiens
  Payload ID: 13923
  Gene Symbol:
  Gene Name: Putative NPIP-like protein LOC729978  [Source:UniProtKB/Swiss-Prot
  Acc:A6NJ64]
  ENSP ID: ENSP00000448752
MFCCLGYEWLSGGCKTWHSAWVINTLADHHHRGTDFGGSPWLRIIIAFPRSYKVVLTLWTVYLWLSFLKTIFQSENGHDVSTDVQQRARRSNRRRQEGNKIGLKDVITLRRHVETKGRAKIRKMKVTTKINHHDKINGKRKTAKKQKLSVKECEHAEKERQVSEAEENGKLDMKEIHTYMKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECLLTPLPPSAPPSADDNLKTPP

SEQ ID NO: 70090 - protein, 250 aa, Homo sapiens
  Payload ID: 13923
  Gene Symbol:
  Gene Name: Putative NPIP-like protein LOC729978  [Source:UniProtKB/Swiss-Prot
  Acc:A6NJ64]
  ENSP ID: ENSP00000478897
MRVLWMLFWLLFWLLLEFISHQSTCVINTLADHHHRGTDFGGSPWLRIIIAFPRSYKVVLTLWTVYLWLSFLKTIFQSENGHDVSTDVQQRARRSNRRRQEGNKIGLKDVITLRRHVETKGRAKIRKMKVTTKINHHDKINGKRKTAKKQKMFQRAQELRRRAEDYHKCKIPPSARKALCNWVSLLVFLAFGHSLPGQDMDTFFSLQLCAQALQREMAERKAAYKHHSPIPVGNRVAQKHLHPHPVGPLI

SEQ ID NO: 70091 - protein, 774 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  Uniprot ID: Q96IC2
  ENSP ID: ENSP00000261377
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQPHLCIQYEVLEAAQLAIESLDGILVDGICIKVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 70092 - protein, 743 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000261378
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFLTRETDAGELPSSRNCQTIKCLSNKEVLEQARVEIPLFPFSIVQFSFKAFSPVLTEEMNKRMRIKWTEISTVYAGPFSKNCNLRALKRLFKSFGPVQSMTFVLETRQVQRPVTELTLDCDTLVNELEGDSENQGSIYLSGVSETFKEQLLQEPRLFLGLEAVILPKDLKSGKQKKYCFLKFKSFGSAQQALNILTGKDWKLKGRHALTPRHLHAWLRGLPPESTRLPGLRVVPPPFEQEALQTLKLDHPKIAAWRWSRKIGKLYNSLCPGTLCLILLPGTKSTHGSLSGLGLMGIKEEEESAGPGLCS

SEQ ID NO: 70093 - protein, 212 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000454262
MSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDL

SEQ ID NO: 70094 - protein, 102 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000455233
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVL

SEQ ID NO: 70095 - protein, 143 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000455677
MDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQE

SEQ ID NO: 70096 - protein, 206 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000455867
  MOD_RES (1)..(1): Any amino acid
XGPKKIAELNLEALANHQEIQAAGQEPKNTAEVLQHPNTSVLECLDSVGQKLLFLTRETDAGELPSSRNCQTIKCLSNKEMRIKWTEISTVYAGPFSKNCNLRALKRLFKSFGPVQSMTFVLETRQVQRPVTELTLDCDTLVNELEGDSENQGSIYLSGVSETFKEQLLQEPRLFLGLEAVILPKDLKSGKQKKYCFLKFKSFGSA

SEQ ID NO: 70097 - protein, 161 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000456030
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPL

SEQ ID NO: 70098 - protein, 88 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000456182
MEPEREGTERHPRKVRESRQAPNKLVGAAEAMKAGWDLEESQPEAKKARLSTILFTDNCEVTHDQLCELLKYAVLGKSNVPKPRAFTF

SEQ ID NO: 70099 - protein, 85 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000456227
MEPEREGTERHPRKVRESRQAPNKLVGAAEAMKAGWDLEESQPEAKKARLSTILFTDNCEVTHDQLCELLKYAVLGKSNVPKPRE

SEQ ID NO: 70100 - protein, 78 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000456643
MSQLHFYRFYLEFGCLRKAFRHKFRLPPPSSDFLADVVGLQTEQRAGDLPKTMEGPLPSNAKAAINLQDDPIIQKYGS

SEQ ID NO: 70101 - protein, 105 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000456666
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGM

SEQ ID NO: 70102 - protein, 774 aa, Homo sapiens; identical to SEQ ID NO: 70091
  Payload ID: 13924
  Gene Symbol:
  Gene Name: Putative RNA exonuclease NEF-sp  [Source:UniProtKB/Swiss-Prot
  Acc:Q96IC2]
  Uniprot ID: Q96IC2
  ENSP ID: ENSP00000457616

SEQ ID NO: 70103 - protein, 172 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000457789
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQ

SEQ ID NO: 70104 - protein, 144 aa, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENSP ID: ENSP00000458004
MSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENFLLTKCNGSIADNSPLFGLDCEMCLTSKGRELTRIS

SEQ ID NO: 70105 - protein, 142 aa, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  Uniprot ID: Q6ZNB5
  ENSP ID: ENSP00000433080
MAPVKISHVVSFSSQDPKYPVENLLNPDSPRRPWLGCPQDKSGQLKVELQLERAVPTGYIDVGNCGCAFLQIDVGHSSWPLDRPFITLLPATTLMSLTDSKQGKNRSGVRMFKDGKEGKSRKDGGGLYEKQRCSTKEDCECY

SEQ ID NO: 70106 - protein, 207 aa, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENSP ID: ENSP00000434508
MYFPGCSTCHLASVGLIFKNSSFLKPQNAFLCYGRRKSSSRGQKAKDPKYPVENLLNPDSPRRPWLGCPQDKSGQLKVELQLERAVPTGYIDVGNCGCAFLQIDVGHSSWPLDRPFITLLPATTLMSLTDSKQGKNRSGVRMFKDVDFLAPASGELWDRLRLTCSRPFTRHQSFGLAFLRVCSSLDSLDDSVVGPSALLSSVLNKIR

SEQ ID NO: 70107 - protein, 134 aa, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENSP ID: ENSP00000435060
MAPVKISHVVSFSSQDPKYPVENLLNPDSPRRPWLGCPQDKSGQLKVELQLERAVPTGYIDVGNCGCAFLQIDVGHSSWPLDRPFITLLPATTLMSLTDSKQGKNRSGVRMFKDGVVAHACNPSTLGDWDKWII

SEQ ID NO: 70108 - protein, 88 aa, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENSP ID: ENSP00000435620
MAPVKISHVVSFSSQDPKYPVENLLNPDSPRRPWLGCPQDKSGQLKVELQLERAVPTGYIDVGNCGCAFLQIDVGHSSWPLDRPFITL

SEQ ID NO: 70109 - protein, 49 aa, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENSP ID: ENSP00000435720
MAPVKISHVVSFSSQDPKYPVENLLNPDSPRRPWLGCPQDKSGQLKVEL

SEQ ID NO: 70110 - protein, 82 aa, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENSP ID: ENSP00000436412
MAPVKISHVVSFSSQDPKYPVENLLNPDSPRRPWLGCPQDKSGQLKVELQLERAVPTGYIDVGNCGCAFLQIDVGHSSWPLD

SEQ ID NO: 70111 - protein, 141 aa, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENSP ID: ENSP00000436725
QDKSGQLKVELQLERAVPTGYIDVGNCGCAFLQIDVGHSSWPLDRPFITLLPATTLMSLTDSKQGKNRSGVRMFKDVDFLAPASGELWDRLRLTCSRPFTRHQSFGLAFLRVCSSLDSLDDSVVGPSALLSSVLNKVGEMF

SEQ ID NO: 70112 - protein, 341 aa, Homo sapiens
  Payload ID: 13926
  Gene Symbol:
  Gene Name: Putative UPF0607 protein ENSP00000381418  [Source:UniProtKB/Swiss-Prot
  Acc:A8MU76]
  Uniprot ID: A8MU76
  ENSP ID: ENSP00000482925
MRLCLSPQNTGTPQRVLPPVVWSPPSRKKPALSARNSTMFGHLRPLRIPRLRGKFNLQLPSFDEQVIPARLPKTEMRAEEPKEATEVKDQVETQGQEDNKRGPCSNGEAASTSRPLETQGNLTSSWYNPRTLEGNVHLKSLTENNQTDKAQVHAVSFYSKGHGVASSHSPAGGILPFGKPDPLPTVLPAPVPGCSLWPEKGALKVLGKDHLPSSPGLLMVGEDMQPKDPAALGSSRSSPPRAAGHSSRKRKLSGPLLQLQLTPPLQLRWDRDEGPPPAKLPCLSPEALLVGQASQREGRLQQGNMHKNMRVLSRTSKFRRLRELLRRRKERRQGRRGGPRL

SEQ ID NO: 70113 - protein, 501 aa, Homo sapiens
  Payload ID: 13927
  Gene Symbol: PWP1
  Gene Name: PWP1 homolog, endonuclein
  Uniprot ID: Q13610
  ENSP ID: ENSP00000387365
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 70114 - protein, 439 aa, Homo sapiens
  Payload ID: 13927
  Gene Symbol: PWP1
  Gene Name: PWP1 homolog, endonuclein
  ENSP ID: ENSP00000445249
MQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 70115 - protein, 98 aa, Homo sapiens
  Payload ID: 13927
  Gene Symbol: PWP1
  Gene Name: PWP1 homolog, endonuclein
  ENSP ID: ENSP00000447770
MQSARTQARPREPLEDGDPEDDRTLDDDELAEYDLDKYDEEGDPDAETLGESLLGLTVYGSNDQDPYVTLKDTEQYEREDFLIKPSDNLIVCGRAEQD

SEQ ID NO: 70116 - protein, 147 aa, Homo sapiens
  Payload ID: 13927
  Gene Symbol: PWP1
  Gene Name: PWP1 homolog, endonuclein
  Uniprot ID: Q13610
  ENSP ID: ENSP00000448227
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTSMTFFSSHLGTI

SEQ ID NO: 70117 - protein, 919 aa, Homo sapiens [sequence omitted]

SEQ ID NO: 70118 - protein, 186 aa, Homo sapiens
  Payload ID: 13928
  Gene Symbol: PWP2
  Gene Name: PWP2 periodic tryptophan protein homolog (yeast)
  ENSP ID: ENSP00000411749
MKFAYRFSNLLGTVYRRGNLNFTCDGNSVISPVGNRVTVFDLKNNKSDTLPLATRYNVKCVGLSPDGRLAIIVDEGSLLSQRVTLPRCIMPLGRSGSSTPSFWTRPILGPTMRPPASTGRMTPGALWLGAKTCPPGCSEPSAGTTSSTMHWGDIRMPSWPASLNPTAWTCTHSARTECCACGSVTR

SEQ ID NO: 70119 - protein, 755 aa, Homo sapiens
  Payload ID: 13929
  Gene Symbol: PWWP2A
  Gene Name: PWWP domain containing 2A
  Uniprot ID: Q96N64
  ENSP ID: ENSP00000305151
MAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAGEAPSENQSPSKGPEEASSEVQDTNEVHVPGDQDEPQTLGKKGSKNNISVYMTLNQKKSDSSSASVCSIDSTDDLKSSNSECSSSESFDFPPGSMHAPSTSSTSSSSKEEKKLSNSLKMKVFSKNVSKCVTPDGRTICVGDIVWAKIYGFPWWPARILTITVSRKDNGLLVRQEARISWFGSPTTSFLALSQLSPFLENFQSRFNKKRKGLYRKAITEAAKAAKQLTPEVRALLTQFET

SEQ ID NO: 70120 - protein, 560 aa, Homo sapiens
  Payload ID: 13929
  Gene Symbol: PWWP2A
  Gene Name: PWWP domain containing 2A
  Uniprot ID: Q96N64
  ENSP ID: ENSP00000390462
MAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAGLNKWQLLHQTVTSPAAPLQCLTDHCGFRLGALKLTVKRAAQRH

SEQ ID NO: 70121 - protein, 520 aa, Homo sapiens
  Payload ID: 13929
  Gene Symbol: PWWP2A
  Gene Name: PWWP domain containing 2A
  Uniprot ID: Q96N64
  ENSP ID: ENSP00000428143
MAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAAQRH

SEQ ID NO: 70122 - protein, 35 aa, Homo sapiens
  Payload ID: 13929
  Gene Symbol: PWWP2A
  Gene Name: PWWP domain containing 2A
  ENSP ID: ENSP00000428636
  MOD_RES (1)..(1): Any amino acid
XKTGLEKMRSGKMAPKPQSRCTSTRSAEFIDQEAD

SEQ ID NO: 70123 - protein, 69 aa, Homo sapiens
  Payload ID: 13929
  Gene Symbol: PWWP2A
  Gene Name: PWWP domain containing 2A
  ENSP ID: ENSP00000430696
VHFTRRYQNPSSGSLPPRVRLKPQRYRNEENDSSLKTGLEKMRSGKMAPKPQSRCTSTRSAEFIDQEAD

SEQ ID NO: 70124 - protein, 49 aa, Homo sapiens
  Payload ID: 13929
  Gene Symbol: PWWP2A
  Gene Name: PWWP domain containing 2A
  ENSP ID: ENSP00000430703
SGVLMDLSKRDHETYGAIALLLVGKIYSHSGEAVWAPWYPCDSISQKGI

SEQ ID NO: 70125 - protein, 590 aa, Homo sapiens
  Payload ID: 13930
  Gene Symbol: PWWP2B
  Gene Name: PWWP domain containing 2B
  Uniprot ID: Q6NUJ5
  ENSP ID: ENSP00000306324
MEPRAGCRLPVRVEQVVNGALVVTVSCGERSFAGILLDCTKKSGLFGLPPLAPLPQVDESPVNDSHGRAPEEGDAEVMQLGSSSPPPARGVQPPETTRPEPPPPLVPPLPAGSLPPYPPYFEGAPFPHPLWLRDTYKLWVPQPPPRTIKRTRRRLSRNRDPGRLILSTIRLRPRQVLCEKCKSTLSPPEASPGPPAAPRARRRLGSGPDRELRKPEEPENGEPTAAATARRSKRERREEDRAPAEQVPRSPVIKISYSTPQGKGEVVKIPSRVHGSLEPFRPQQAPQDDGSQDPEVLDRESRDRPSCAPSASIPKLKLTRPVPAGADLPPPKIRLKPHRLGDSEHEPVYRAELVGELNGYLRDSSPAPCADGPAGGLADLSSGSSGEDDDFKSCPQGPQGREGLAFLVSCPEGRADCASESACSSDSLDEARSSGSEGTPADTGDLSPGHGASAPSVSREARQTVPPLTVRLHTQSVSECITEDGRTVAVGDIVWGKIHGFPWWPARVLDISLGQKEDGEPSWREAKVSWFGSPTTSFLSISKLSPFSEFFKLRFNRKKKGMYRKAITEAANAARHVAPEIRELLTQFET

SEQ ID NO: 70126 - protein, 499 aa, Homo sapiens
  Payload ID: 13930
  Gene Symbol: PWWP2B
  Gene Name: PWWP domain containing 2B
  Uniprot ID: Q6NUJ5
  ENSP ID: ENSP00000486501
MEPRAGCRLPVRVEQVVNGALVVTVSCGERSFAGILLDCTKKSGLFGLPPLAPLPQVDESPVNDSHGRAPEEGDAEVMQLGSSSPPPARGVQPPETTRPEPPPPLVPPLPAGSLPPYPPYFEGAPFPHPLWLRDTYKLWVPQPPPRTIKRTRRRLSRNRDPGRLILSTIRLRPRQVLCEKCKSTLSPPEASPGPPAAPRARRRLGSGPDRELRKPEEPENGEPTAAATARRSKRERREEDRAPAEQVPRSPVIKISYSTPQGKGEVVKIPSRVHGSLEPFRPQQAPQDDGSQDPEVLDRESRDRPSCAPSASIPKLKLTRPVPAGADLPPPKIRLKPHRLGDSEHEPVYRAELVGELNGYLRDSSPAPCADGPAGGLADLSSGSSGEDDDFKSCPQGPQGREGLAFLVSCPEGRADCASESACSSDSLDEARSSGSEGTPADTGDLSPGHGASAPSVSREARQTVPPLTVRLHTQSVSECITEDGRTVAVGDIVWGHRR

SEQ ID NO: 70127 - protein, 179 aa, Homo sapiens
  Payload ID: 13931
  Gene Symbol: PXDC1
  Gene Name: PX domain containing 1
  ENSP ID: ENSP00000369630
  MOD_RES (1)..(1): Any amino acid
XQSRRIEPVMGRLLLCASHGEIEKHPSLHASSYGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQQLGVDPTEHLFENGSEFPSELEDGDDPAAYVTNLSYYHLVPFETDIWD

SEQ ID NO: 70128 - protein, 231 aa, Homo sapiens
  Payload ID: 13931
  Gene Symbol: PXDC1
  Gene Name: PX domain containing 1
  Uniprot ID: Q5TGL8
  ENSP ID: ENSP00000369636
MASAVFEGTSLVNMFVRGCWVNGIRRLIVSRRGDEEEFFEIRTEWSDRSVLYLHRSLADLGRLWQRLRDAFPEDRSELAQGPLRQGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQQLGVDPTEHLFENGSEFPSELEDGDDPAAYVTNLSYYHLVPFETDIWD

SEQ ID NO: 70129 - protein, 557 aa, Homo sapiens
  Payload ID: 13932
  Gene Symbol: PXK
  Gene Name: PX domain containing serine/threonine kinase
  ENSP ID: ENSP00000305045
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSGISALPPPPPPPPPPAAPLPPASTEAPAQLSSQAVNGMSRGALLSSIQNFQKGTLRKAKTCDHSAPKIG

SEQ ID NO: 70130 - protein, 578 aa, Homo sapiens
  Payload ID: 13932
  Gene Symbol: PXK
  Gene Name: PX domain containing serine/threonine kinase
  Uniprot ID: Q7Z7A4
  ENSP ID: ENSP00000348472
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 70131 - protein, 498 aa, Homo sapiens
  Payload ID: 13932
  Gene Symbol: PXK
  Gene Name: PX domain containing serine/threonine kinase
  ENSP ID: ENSP00000373221
MAFMEKPPAGKVLLDDTVPLTAAIEASQSLQSHTIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSVEHAPF

SEQ ID NO: 70132 - protein, 515 aa, Homo sapiens
  Payload ID: 13932
  Gene Symbol: PXK
  Gene Name: PX domain containing serine/threonine kinase
  Uniprot ID: Q7Z7A4
  ENSP ID: ENSP00000373222
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSVEHAPF

SEQ ID NO: 70133 - protein, 56 aa, Homo sapiens
  Payload ID: 13932
  Gene Symbol: PXK
  Gene Name: PX domain containing serine/threonine kinase
  ENSP ID: ENSP00000417167
MAFMEKPPAGKVLLDDTVPLTAAIEASQSLQSHTRLPCNRFPCSSDQNQSGRWWNL

SEQ ID NO: 70134 - protein, 482 aa, Homo sapiens
  Payload ID: 13932
  Gene Symbol: PXK
  Gene Name: PX domain containing serine/threonine kinase
  ENSP ID: ENSP00000417903
MAFMEKPPAGKVLLDDTVPLTAAIEASQSLQSHTIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSVEHAPF

SEQ ID NO: 70135 - protein, 515 aa, Homo sapiens; identical to SEQ ID NO: 70132
  Payload ID: 13932
  Gene Symbol: PXK
  Gene Name: PX domain containing serine/threonine kinase
  Uniprot ID: Q7Z7A4
  ENSP ID: ENSP00000417915

SEQ ID NO: 70136 - protein, 312 aa, Homo sapiens
  Payload ID: 13932
  Gene Symbol: PXK
  Gene Name: PX domain containing serine/threonine kinase
  ENSP ID: ENSP00000418202
  MOD_RES (1)..(1): Any amino acid
XFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSGISALPPPPPPPPPPAAPLPPASTEAPAQLSSQAVNGMSRGALLSSIQNFQKGTLRKAKTCDHSAPKIG

SEQ ID NO: 70137 - protein, 85 aa, Homo sapiens
  Payload ID: 13932
  Gene Symbol: PXK
  Gene Name: PX domain containing serine/threonine kinase
  ENSP ID: ENSP00000418376
  MOD_RES (1)..(1): Any amino acid
XLIEEQKQIHQHRRLTRAQSHHGSEEERKKRKILARKKSKRSALENSEEHSAKYSNSNNSGSGASSPLTSPSSPTPPSTSEHAPF

SEQ ID NO: 70138 - protein, 113 aa, Homo sapiens
  Payload ID: 13932
  Gene Symbol: PXK
  Gene Name: PX domain containing serine/threonine kinase
  ENSP ID: ENSP00000418831
MKCDSRAYLLGQQSVSGWGLQPRFQEYIIRVQRGISVENSWQIVRRYSDFDLLNNSLQIAGLSLPLPPKKLIGNMDREFIAERQKGLQNYLNVITTNHILSNCELVKKFLDPN

SEQ ID NO: 70139 - protein, 50 aa, Homo sapiens
  Payload ID: 13932
  Gene Symbol: PXK
  Gene Name: PX domain containing serine/threonine kinase
  ENSP ID: ENSP00000418836
KKSKRSALENSEEHSAKYSNSNNSGSGASSPLTSPSSPTPPSTSVEHAPF

SEQ ID NO: 70140 - protein, 563 aa, Homo sapiens
  Payload ID: 13932
  Gene Symbol: PXK
  Gene Name: PX domain containing serine/threonine kinase
  ENSP ID: ENSP00000419049
MAFMEKPPAGKVLLDDTVPLTAAIEASQSLQSHTIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSGSGASSPLTSPSSPTPPSTSAALGLSKRCKERDICITSTSSTSTTTSSSLASCEHRGTCPALVSGCEWHEPRGLAQLHPEFPKRNFEESQNL

SEQ ID NO: 70141 - protein, 141 aa, Homo sapiens
  Payload ID: 13932
  Gene Symbol: PXK
  Gene Name: PX domain containing serine/threonine kinase
  ENSP ID: ENSP00000420403
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTAPLHLSGYLCHS

SEQ ID NO: 70142 - protein, 203 aa, Homo sapiens
  Payload ID: 13932
  Gene Symbol: PXK
  Gene Name: PX domain containing serine/threonine kinase
  ENSP ID: ENSP00000476179
NSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSG

SEQ ID NO: 70143 - protein, 89 aa, Homo sapiens
  Payload ID: 13933
  Gene Symbol: PYDC1
  Gene Name: PYD (pyrin domain) containing 1
  Uniprot ID: Q8WXC3
  ENSP ID: ENSP00000304336
MGTKREAILKVLENLTPEELKKFKMKLGTVPLREGFERIPRGALGQLDIVDLTDKLVASYYEDYAAELVVAVLRDMRMLEEAARLQRAA

SEQ ID NO: 70144 - protein, 195 aa, Homo sapiens
  Payload ID: 13934
  Gene Symbol: PYCARD
  Gene Name: PYD and CARD domain containing
  Uniprot ID: Q9ULZ3
  ENSP ID: ENSP00000247470
MGRARDAILDALENLTAEELKKFKLKLLSVPLREGYGRIPRGALLSMDALDLTDKLVSFYLETYGAELTANVLRDMGLQEMAGQLQAATHQGSGAAPAGIQAPPQSAAKPGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 70145 - protein, 176 aa, Homo sapiens
  Payload ID: 13934
  Gene Symbol: PYCARD
  Gene Name: PYD and CARD domain containing
  Uniprot ID: Q9ULZ3
  ENSP ID: ENSP00000340441
MGRARDAILDALENLTAEELKKFKLKLLSVPLREGYGRIPRGALLSMDALDLTDKLVSFYLETYGAELTANVLRDMGLQEMAGQLQAATHQGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 70146 - protein, 125 aa, Homo sapiens
  Payload ID: 13934
  Gene Symbol: PYCARD
  Gene Name: PYD and CARD domain containing
  ENSP ID: ENSP00000455141
MGRARDAILDALENLTAEELKKFKLKLLSVPLREGYGRIPRGALLSMDALDLTDKLVSFYLETYGAELTANVLRDMGLQEMAGQLQAATHQGGSPRLAYRPTGPRPHGGKGREGDHLAHILPGSG

SEQ ID NO: 70147 - protein, 419 aa, Homo sapiens
  Payload ID: 13935
  Gene Symbol: PYGO1
  Gene Name: pygopus family PHD finger 1
  Uniprot ID: Q9Y3Y4
  ENSP ID: ENSP00000302327
MPAENSPAPAYKVSSHGGDSGLDGLGGPGVQLGSPDKKKRKANTQGPSFPPLSEYAPPPNPNSDHLVAANPFDDNYNTISYKPLPSSNPYLGPGYPGFGGYSTFRMPPHVPPRMSSPYCGPYSLRNQPHPFPQNPLGMGFNRPHAFNFGPHDNSSFGNPSYNNALSQNVNMPNQHFRQNPAENFSQIPPQNASQVSNPDLASNFVPGNNSNFTSPLESNHSFIPPPNTFGQAKAPPPKQDFTQGATKNTNQNSSAHPPHLNMDDTVNQSNIELKNVNRNNAVNQENSRSSSTEATNNNPANGTQNKPRQPRGAADACTTEKSNKSSLHPNRHGHSSSDPVYPCGICTNEVNDDQDAILCEASCQKWFHRICTGMTETAYGLLTAEASAVWGCDTCMADKDVQLMRTRETFGPSAVGSDA

SEQ ID NO: 70148 - protein, 419 aa, Homo sapiens
  Payload ID: 13935
  Gene Symbol: PYGO1
  Gene Name: pygopus family PHD finger 1
  Uniprot ID: Q9Y3Y4
  ENSP ID: ENSP00000457777
MSAEQEKDPISLKRVRGGDSGLDGLGGPGVQLGSPDKKKRKANTQGPSFPPLSEYAPPPNPNSDHLVAANPFDDNYNTISYKPLPSSNPYLGPGYPGFGGYSTFRMPPHVPPRMSSPYCGPYSLRNQPHPFPQNPLGMGFNRPHAFNFGPHDNSSFGNPSYNNALSQNVNMPNQHFRQNPAENFSQIPPQNASQVSNPDLASNFVPGNNSNFTSPLESNHSFIPPPNTFGQAKAPPPKQDFTQGATKNTNQNSSAHPPHLNMDDTVNQSNIELKNVNRNNAVNQENSRSSSTEATNNNPANGTQNKPRQPRGAADACTTEKSNKSSLHPNRHGHSSSDPVYPCGICTNEVNDDQDAILCEASCQKWFHRICTGMTETAYGLLTAEASAVWGCDTCMADKDVQLMRTRETFGPSAVGSDA

SEQ ID NO: 70149 - protein, 369 aa, Homo sapiens
  Payload ID: 13936
  Gene Symbol: PYGO2
  Gene Name: pygopus family PHD finger 2
  ENSP ID: ENSP00000357441
MKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 70150 - protein, 406 aa, Homo sapiens
  Payload ID: 13936
  Gene Symbol: PYGO2
  Gene Name: pygopus family PHD finger 2
  Uniprot ID: Q9BRQ0
  ENSP ID: ENSP00000357442
MAASAPPPPDKLEGGGGPAPPPAPPSTGRKQGKAGLQMKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 70151 - protein, 203 aa, Homo sapiens
  Payload ID: 13937
  Gene Symbol: PYM1
  Gene Name: PYM homolog 1, exon junction complex associated factor
  Uniprot ID: Q9BRP8
  ENSP ID: ENSP00000381271
MATPYVTDETGGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 70152 - protein, 204 aa, Homo sapiens
  Payload ID: 13937
  Gene Symbol: PYM1
  Gene Name: PYM homolog 1, exon junction complex associated factor
  Uniprot ID: Q9BRP8
  ENSP ID: ENSP00000386156
MEAAGSPAATETGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 70153 - protein, 77 aa, Homo sapiens
  Payload ID: 13937
  Gene Symbol: PYM1
  Gene Name: PYM homolog 1, exon junction complex associated factor
  ENSP ID: ENSP00000402829
MVHSPFKTKMVACYDRDSTSGGEGGGTPARSRRKWFAFSRWRLPMLLTRPAGWEPPNLSLLFDFTLGYHQGQRMEPR

SEQ ID NO: 70154 - protein, 45 aa, Homo sapiens
  Payload ID: 13937
  Gene Symbol: PYM1
  Gene Name: PYM homolog 1, exon junction complex associated factor
  ENSP ID: ENSP00000448858
MPSNICHSSSGRLISPIKVKSEIQTQASISRQHSDLTGPGASSGG

SEQ ID NO: 70155 - protein, 37 aa, Homo sapiens
  Payload ID: 13937
  Gene Symbol: PYM1
  Gene Name: PYM homolog 1, exon junction complex associated factor
  ENSP ID: ENSP00000452291
  MOD_RES (1)..(1): Any amino acid
XLPAALRLRRQGWEPPNLSLLFDFTLGYHQGQRMEPR

SEQ ID NO: 70156 - protein, 44 aa, Homo sapiens
  Payload ID: 13937
  Gene Symbol: PYM1
  Gene Name: PYM homolog 1, exon junction complex associated factor
  ENSP ID: ENSP00000452447
MRGTVPRNFSWLPEDCFTGSKRSVMASISRQHSDLTGPGASSGG

SEQ ID NO: 70157 - protein, 500 aa, Homo sapiens
  Payload ID: 13938
  Gene Symbol: PYROXD1
  Gene Name: pyridine nucleotide-disulphide oxidoreductase domain 1
  Uniprot ID: Q8WU10
  ENSP ID: ENSP00000240651
MEAARPPPTAGKFVVVGGGIAGVTCAEQLATHFPSEDILLVTASPVIKAVTNFKQISKILEEFDVEEQSSTMLGKRFPNIKVIESGVKQLKSEEHCIVTEDGNQHVYKKLCLCAGAKPKLICEGNPYVLGIRDTDSAQEFQKQLTKAKRIMIIGNGGIALELVYEIEGCEVIWAIKDKAIGNTFFDAGAAEFLTSKLIAEKSEAKIAHKRTRYTTEGRKKEARSKSKADNVGSALGPDWHEGLNLKGTKEFSHKIHLETMCEVKKIYLQDEFRILKKKSFTFPRDHKSVTADTEMWPVYVELTNEKIYGCDFIVSATGVTPNVEPFLHGNSFDLGEDGGLKVDDHMHTSLPDIYAAGDICTTSWQLSPVWQQMRLWTQARQMGWYAAKCMAAASSGDSIDMDFSFELFAHVTKFFNYKVVLLGKYNAQGLGSDHELMLRCTKGREYIKVVMQNGRMMGAVLIGETDLEETFENLILNQMNLSSYGEDLLDPNIDIEDYFD

SEQ ID NO: 70158 - protein, 55 aa, Homo sapiens
  Payload ID: 13938
  Gene Symbol: PYROXD1
  Gene Name: pyridine nucleotide-disulphide oxidoreductase domain 1
  ENSP ID: ENSP00000364415
MEAARPPPTAGKFVVVGGGIAGVTCAEQLATHFPSEDILLVTASPVIKAVTNFKQ

SEQ ID NO: 70159 - protein, 429 aa, Homo sapiens
  Payload ID: 13938
  Gene Symbol: PYROXD1
  Gene Name: pyridine nucleotide-disulphide oxidoreductase domain 1
  Uniprot ID: Q8WU10
  ENSP ID: ENSP00000438505
MLGKRFPNIKVIESGVKQLKSEEHCIVTEDGNQHVYKKLCLCAGAKPKLICEGNPYVLGIRDTDSAQEFQKQLTKAKRIMIIGNGGIALELVYEIEGCEVIWAIKDKAIGNTFFDAGAAEFLTSKLIAEKSEAKIAHKRTRYTTEGRKKEARSKSKADNVGSALGPDWHEGLNLKGTKEFSHKIHLETMCEVKKIYLQDEFRILKKKSFTFPRDHKSVTADTEMWPVYVELTNEKIYGCDFIVSATGVTPNVEPFLHGNSFDLGEDGGLKVDDHMHTSLPDIYAAGDICTTSWQLSPVWQQMRLWTQARQMGWYAAKCMAAASSGDSIDMDFSFELFAHVTKFFNYKVVLLGKYNAQGLGSDHELMLRCTKGREYIKVVMQNGRMMGAVLIGETDLEETFENLILNQMNLSSYGEDLLDPNIDIEDYFD

SEQ ID NO: 70160 - protein, 139 aa, Homo sapiens
  Payload ID: 13938
  Gene Symbol: PYROXD1
  Gene Name: pyridine nucleotide-disulphide oxidoreductase domain 1
  ENSP ID: ENSP00000439106
MEAARPPPTAGKFVVVGGGIAGVTCAEQLATHFPSEDILLVTASPVIKAVTNFKQISKILEEFDVEEQSSTMLGKRFPNIKVIESGVKQLKSEEHCIVTEDGNQHVYKKLCLCAGAKPKLICEGNPYVLGIRDTDSAQV

SEQ ID NO: 70161 - protein, 139 aa, Homo sapiens; identical to SEQ ID NO: 70160
  Payload ID: 13938
  Gene Symbol: PYROXD1
  Gene Name: pyridine nucleotide-disulphide oxidoreductase domain 1
  ENSP ID: ENSP00000440192

SEQ ID NO: 70162 - protein, 60 aa, Homo sapiens
  Payload ID: 13938
  Gene Symbol: PYROXD1
  Gene Name: pyridine nucleotide-disulphide oxidoreductase domain 1
  ENSP ID: ENSP00000444800
  MOD_RES (1)..(1): Any amino acid
XKSEAKIAHKRTRYTTEGRKKEARSKSKADNVGSALGPDWHEGLNLKGTKEQYSQHPHQK

SEQ ID NO: 70163 - protein, 581 aa, Homo sapiens
  Payload ID: 13939
  Gene Symbol: PYROXD2
  Gene Name: pyridine nucleotide-disulphide oxidoreductase domain 2
  Uniprot ID: Q8N2H3
  ENSP ID: ENSP00000359607
MAASGRGLCKAVAASPFPAWRRDNTEARGGLKPEYDAVVIGAGHNGLVAAAYLQRLGVNTAVFERRHVIGGAAVTEEIIPGFKFSRASYLLSLLRPQIYTDLELKKHGLRLHLRNPYSFTPMLEEGAGSKVPRCLLLGTDMAENQKQIAQFSQKDAQVFPKYEEFMHRLALAIDPLLDAAPVDMAAFQHGSLLQRMRSLSTLKPLLKAGRILGAQLPRYYEVLTAPITKVLDQWFESEPLKATLATDAVIGAMTSPHTPGSGYVLLHHVMGGLEGMQGAWGYVQGGMGALSDAIASSATTHGASIFTEKTVAKVQVNSEGCVQGVVLEDGTEVRSKMVLSNTSPQITFLKLTPQEWLPEEFLERISQLDTRSPVTKINVAVDRLPSFLAAPNAPRGQPLPHHQCSIHLNCEDTLLLHQAFEDAMDGLPSHRPVIELCIPSSLDPTLAPPGCHVVSLFTQYMPYTLAGGKAWDEQERDAYADRVFDCIEVYAPGFKDSVVGRDILTPPDLERIFGLPGGNIFHCAMSLDQLYFARPVPLHSGYRCPLQGLYLCGSGAHPGGGVMGAAGRNAAHVAFRDLKSM

SEQ ID NO: 70164 - protein, 312 aa, Homo sapiens
  Payload ID: 13940
  Gene Symbol: PDXK
  Gene Name: pyridoxal (pyridoxine, vitamin B6) kinase
  Uniprot ID: O00764
  ENSP ID: ENSP00000291565
MEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 70165 - protein, 148 aa, Homo sapiens
  Payload ID: 13940
  Gene Symbol: PDXK
  Gene Name: pyridoxal (pyridoxine, vitamin B6) kinase
  ENSP ID: ENSP00000333624
MGRLWKRPDQLAMLMNKLILMGCVKRRCQPRGSACSCSHLKAENSDFILGYVCQPQRINYLHTQKQWSRIFWQDFQDLCHRCLISVSSQSVLGFEIDAVNSVQFSNHTETRSVSVAQAGVKWRNQLTAALTSWAEAIFLPPPPEWLGL

SEQ ID NO: 70166 - protein, 87 aa, Homo sapiens
  Payload ID: 13940
  Gene Symbol: PDXK
  Gene Name: pyridoxal (pyridoxine, vitamin B6) kinase
  ENSP ID: ENSP00000381155
MEEECRVLSIQSHVIRGYVGNRAATFPLQVLGFEIDAVNSVQFSNHTETRSVSVAQAGVKWRNQLTAALTSWAEAIFLPPPPEWLGL

SEQ ID NO: 70167 - protein, 284 aa, Homo sapiens
  Payload ID: 13940
  Gene Symbol: PDXK
  Gene Name: pyridoxal (pyridoxine, vitamin B6) kinase
  Uniprot ID: O00764
  ENSP ID: ENSP00000418359
MEEECRVLSIQSHVIRGYVGNRAATFPLQVLGFEIDAVNSVQFSNHTGYAHWKGQVLNSDELQELYEGLRLNNMNKYDYVLTVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 70168 - protein, 272 aa, Homo sapiens
  Payload ID: 13940
  Gene Symbol: PDXK
  Gene Name: pyridoxal (pyridoxine, vitamin B6) kinase
  ENSP ID: ENSP00000420708
MGRSRPPGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 70169 - protein, 162 aa, Homo sapiens
  Payload ID: 13940
  Gene Symbol: PDXK
  Gene Name: pyridoxal (pyridoxine, vitamin B6) kinase
  ENSP ID: ENSP00000479315
MGHKARLPAGTRVFHTSCVVGSLTPFRLGGGKADPPSACRAHLAQASPPRGCCSHFCPFPRPGPRSLRPYHKVRSFFHTVSWAWQSLHLVASIPSGPFERISWSSLSELPGLRALGRSLRSWRSAGGRVALSWLSECRARGDGTGALLLGLVVPAAGKGQLV

SEQ ID NO: 70170 - protein, 296 aa, Homo sapiens
  Payload ID: 13941
  Gene Symbol: PDXP
  Gene Name: pyridoxal (pyridoxine, vitamin B6) phosphatase
  Uniprot ID: Q96GD0
  ENSP ID: ENSP00000215904
MARCERLRGAALRDVLGRAQGVLFDCDGVLWNGERAVPGAPELLERLARAGKAALFVSNNSRRARPELALRFARLGFGGLRAEQLFSSALCAARLLRQRLPGPPDAPGAVFVLGGEGLRAELRAAGLRLAGDPSAGDGAAPRVRAVLVGYDEHFSFAKLREACAHLRDPECLLVATDRDPWHPLSDGSRTPGTGSLAAAVETASGRQALVVGKPSPYMFECITENFSIDPARTLMVGDRLETDILFGHRCGMTTVLTLTGVSRLEEAQAYLAAGQHDLVPHYYVESIADLTEGLED

SEQ ID NO: 70171 - protein, 79 aa, Homo sapiens
  Payload ID: 13941
  Gene Symbol: PDXP
  Gene Name: pyridoxal (pyridoxine, vitamin B6) phosphatase
  ENSP ID: ENSP00000385336
MFECITENFSIDPARTLMVGDRLETDILFGHRCGMTTVLTLTGVSRLEEAQAYLAAGQHDLVPHYYVESIADLTEGLED

SEQ ID NO: 70172 - protein, 370 aa, Homo sapiens
  Payload ID: 13942
  Gene Symbol: PDXDC1
  Gene Name: pyridoxal-dependent decarboxylase domain containing 1
  ENSP ID: ENSP00000322807
MDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQKV

SEQ ID NO: 70173 - protein, 788 aa, Homo sapiens
  Payload ID: 13942
  Gene Symbol: PDXDC1
  Gene Name: pyridoxal-dependent decarboxylase domain containing 1
  Uniprot ID: Q6P996
  ENSP ID: ENSP00000379691
MDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 70174 - protein, 697 aa, Homo sapiens
  Payload ID: 13942
  Gene Symbol: PDXDC1
  Gene Name: pyridoxal-dependent decarboxylase domain containing 1
  Uniprot ID: Q6P996
  ENSP ID: ENSP00000391147
MGKNLKEAVKMLEDSQRRTEEENGKKLISGDIPGPLQGRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 70175 - protein, 429 aa, Homo sapiens
  Payload ID: 13942
  Gene Symbol: PDXDC1
  Gene Name: pyridoxal-dependent decarboxylase domain containing 1
  Uniprot ID: Q6P996
  ENSP ID: ENSP00000406703
MDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWVRMAVTPLSFQVPVHHHPTCW

SEQ ID NO: 70176 - protein, 498 aa, Homo sapiens
  Payload ID: 13942
  Gene Symbol: PDXDC1
  Gene Name: pyridoxal-dependent decarboxylase domain containing 1
  ENSP ID: ENSP00000437835
MDASLEKIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAGWSHCGTTTRYDCVRSRLTTRLPGSTGEQAPP

SEQ ID NO: 70177 - protein, 81 aa, Homo sapiens
  Payload ID: 13942
  Gene Symbol: PDXDC1
  Gene Name: pyridoxal-dependent decarboxylase domain containing 1
  ENSP ID: ENSP00000454279
MDASLEKIADPTLAEMGKNLKEAVKMLEDSQRRTEEENGKKLISGDIPGPLQGSGQDMVSILQLVQNLMHGDEDEEPQSPR

SEQ ID NO: 70178 - protein, 806 aa, Homo sapiens
  Payload ID: 13942
  Gene Symbol: PDXDC1
  Gene Name: pyridoxal-dependent decarboxylase domain containing 1
  ENSP ID: ENSP00000454791
MACSILEGCRREVRRETWKPGPGSEIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 70179 - protein, 271 aa, Homo sapiens
  Payload ID: 13942
  Gene Symbol: PDXDC1
  Gene Name: pyridoxal-dependent decarboxylase domain containing 1
  ENSP ID: ENSP00000454910
MGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQDVAFLEKLIKDDIERGRLPLLLVANAGTAAVGHTDKIGRLKELCEQYGIWLHVEGVNLATLALGYVSSSVLAAAKCDSMTMTPGPWLGLPAVP

SEQ ID NO: 70180 - protein, 761 aa, Homo sapiens
  Payload ID: 13942
  Gene Symbol: PDXDC1
  Gene Name: pyridoxal-dependent decarboxylase domain containing 1
  Uniprot ID: Q6P996
  ENSP ID: ENSP00000455070
MDASLEKIADPTLAEMGKNLKEAVKMLEDSQRRTEEENGKKLISGDIPGPLQGRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 70181 - protein, 64 aa, Homo sapiens
  Payload ID: 13942
  Gene Symbol: PDXDC1
  Gene Name: pyridoxal-dependent decarboxylase domain containing 1
  ENSP ID: ENSP00000455486
MDASLEKIADPTLAEMGKNLKEAVKMLEDSQRRTEEENGKKLISGDIPGPLQGSGQDMALSIRA

SEQ ID NO: 70182 - protein, 185 aa, Homo sapiens
  Payload ID: 13942
  Gene Symbol: PDXDC1
  Gene Name: pyridoxal-dependent decarboxylase domain containing 1
  ENSP ID: ENSP00000455613
  MOD_RES (1)..(1): Any amino acid
XSILEGCRREVRRETWKPGPGSEAAGKSLVNNPPGILPPSPAHVREGRRGAQIADPTLAEMGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGCAYFHE

SEQ ID NO: 70183 - protein, 24 aa, Homo sapiens
  Payload ID: 13942
  Gene Symbol: PDXDC1
  Gene Name: pyridoxal-dependent decarboxylase domain containing 1
  ENSP ID: ENSP00000455914
MGKNLKEAVKMLEDSQRRTEEENG

SEQ ID NO: 70184 - protein, 120 aa, Homo sapiens
  Payload ID: 13942
  Gene Symbol: PDXDC1
  Gene Name: pyridoxal-dependent decarboxylase domain containing 1
  ENSP ID: ENSP00000457417
MGKNLKEAVKMLEDSQRRTEEENGKKLISGDIPGPLQGSGQDMVSILQLVQNLMHGDEDEEPQSPRIQNIGEQGHMALLGHSLGAYISTLDKEKLRKLTTRILSDTTLWLCRIFRYENGC

SEQ ID NO: 70185 - protein, 370 aa, Homo sapiens; identical to SEQ ID NO: 70172
  Payload ID: 13942
  Gene Symbol: PDXDC1
  Gene Name: pyridoxal-dependent decarboxylase domain containing 1
  ENSP ID: ENSP00000478642

SEQ ID NO: 70186 - protein, 761 aa, Homo sapiens; identical to SEQ ID NO: 70180
  Payload ID: 13942
  Gene Symbol: PDXDC1
  Gene Name: pyridoxal-dependent decarboxylase domain containing 1
  Uniprot ID: Q6P996
  ENSP ID: ENSP00000478686

SEQ ID NO: 70187 - protein, 429 aa, Homo sapiens; identical to SEQ ID NO: 70175
  Payload ID: 13942
  Gene Symbol: PDXDC1
  Gene Name: pyridoxal-dependent decarboxylase domain containing 1
  Uniprot ID: Q6P996
  ENSP ID: ENSP00000479054

SEQ ID NO: 70188 - protein, 697 aa, Homo sapiens; identical to SEQ ID NO: 70174
  Payload ID: 13942
  Gene Symbol: PDXDC1
  Gene Name: pyridoxal-dependent decarboxylase domain containing 1
  Uniprot ID: Q6P996
  ENSP ID: ENSP00000480418

SEQ ID NO: 70189 - protein, 429 aa, Homo sapiens; identical to SEQ ID NO: 70175
  Payload ID: 13942
  Gene Symbol: PDXDC1
  Gene Name: pyridoxal-dependent decarboxylase domain containing 1
  Uniprot ID: Q6P996
  ENSP ID: ENSP00000481784

SEQ ID NO: 70190 - protein, 498 aa, Homo sapiens; identical to SEQ ID NO: 70176
  Payload ID: 13942
  Gene Symbol: PDXDC1
  Gene Name: pyridoxal-dependent decarboxylase domain containing 1
  ENSP ID: ENSP00000481952

SEQ ID NO: 70191 - protein, 204 aa, Homo sapiens
  Payload ID: 13942
  Gene Symbol: PDXDC1
  Gene Name: pyridoxal-dependent decarboxylase domain containing 1
  ENSP ID: ENSP00000482152
MTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAGWSHCGTTTRYDCVRSRLTTRLPGSTGEQAPP

SEQ ID NO: 70192 - protein, 370 aa, Homo sapiens; identical to SEQ ID NO: 70172
  Payload ID: 13942
  Gene Symbol: PDXDC1
  Gene Name: pyridoxal-dependent decarboxylase domain containing 1
  ENSP ID: ENSP00000483586

SEQ ID NO: 70193 - protein, 498 aa, Homo sapiens; identical to SEQ ID NO: 70176
  Payload ID: 13942
  Gene Symbol: PDXDC1
  Gene Name: pyridoxal-dependent decarboxylase domain containing 1
  ENSP ID: ENSP00000483785

SEQ ID NO: 70194 - protein, 204 aa, Homo sapiens; identical to SEQ ID NO: 70191
  Payload ID: 13942
  Gene Symbol: PDXDC1
  Gene Name: pyridoxal-dependent decarboxylase domain containing 1
  ENSP ID: ENSP00000483806

SEQ ID NO: 70195 - protein, 788 aa, Homo sapiens; identical to SEQ ID NO: 70173
  Payload ID: 13942
  Gene Symbol: PDXDC1
  Gene Name: pyridoxal-dependent decarboxylase domain containing 1
  Uniprot ID: Q6P996
  ENSP ID: ENSP00000484595

SEQ ID NO: 70196 - protein, 806 aa, Homo sapiens; identical to SEQ ID NO: 70178
  Payload ID: 13942
  Gene Symbol: PDXDC1
  Gene Name: pyridoxal-dependent decarboxylase domain containing 1
  ENSP ID: ENSP00000484608

SEQ ID NO: 70197 - protein, 760 aa, Homo sapiens
  Payload ID: 13942
  Gene Symbol: PDXDC1
  Gene Name: pyridoxal-dependent decarboxylase domain containing 1
  Uniprot ID: Q6P996
  ENSP ID: ENSP00000486662
MDASLEKIADPTLAEMGKNLKEAVKMLEDSQRTEEENGKKLISGDIPGPLQGRIQNIGEQGHMALLGHSLGAYISTLDKEKLRKLTTRILSDTTLWLCRIFRYENGCAYFHEEEREGLAKICRLAIHSRYEDFVVDGFNVLYNKKPVIYLSAAARPGLGQYLCNQLGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 70198 - protein, 64 aa, Homo sapiens; identical to SEQ ID NO: 70181
  Payload ID: 13942
  Gene Symbol: PDXDC1
  Gene Name: pyridoxal-dependent decarboxylase domain containing 1
  ENSP ID: ENSP00000487882

SEQ ID NO: 70199 - protein, 185 aa, Homo sapiens; identical to SEQ ID NO: 70182
  Payload ID: 13942
  Gene Symbol: PDXDC1
  Gene Name: pyridoxal-dependent decarboxylase domain containing 1
  ENSP ID: ENSP00000487950
  MOD_RES (1)..(1): Any amino acid

SEQ ID NO: 70200 - protein, 98 aa, Homo sapiens
  Payload ID: 13942
  Gene Symbol: PDXDC1
  Gene Name: pyridoxal-dependent decarboxylase domain containing 1
  ENSP ID: ENSP00000488405
MDASLEKIADPTLAEMGKNLKEAVKMLEDSQRRTEEENGKKLISGDIPGPLQGRIQNIGEQGHMALLGHSLGAYISTLDKEKLRKLTTRILSDTTLWL

SEQ ID NO: 70201 - protein, 760 aa, Homo sapiens; identical to SEQ ID NO: 70197
  Payload ID: 13942
  Gene Symbol: PDXDC1
  Gene Name: pyridoxal-dependent decarboxylase domain containing 1
  Uniprot ID: Q6P996
  ENSP ID: ENSP00000488664

SEQ ID NO: 70202 - protein, 261 aa, Homo sapiens
  Payload ID: 13943
  Gene Symbol: PNPO
  Gene Name: pyridoxamine 5'-phosphate oxidase
  Uniprot ID: Q9NVS9
  ENSP ID: ENSP00000225573
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 70203 - protein, 218 aa, Homo sapiens
  Payload ID: 13943
  Gene Symbol: PNPO
  Gene Name: pyridoxamine 5'-phosphate oxidase
  Uniprot ID: Q9NVS9
  ENSP ID: ENSP00000399960
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELDSNPFASLVFYWEPLNRQYLRKKNEELEQLYQDQEVPKPKSWGGYVLYPQVMEFWQGQTNRLHDRIVFRRGLPTGDSPLGPMTHRGEEDWLYERLAP

SEQ ID NO: 70204 - protein, 69 aa, Homo sapiens
  Payload ID: 13943
  Gene Symbol: PNPO
  Gene Name: pyridoxamine 5'-phosphate oxidase
  ENSP ID: ENSP00000462345
MTCWLRGVTATFGRPAEWPGYLSHLCGRSAAMDLGPMRKSYRGDRERWKTLCSHVAAEGLRERWLPLLH

SEQ ID NO: 70205 - protein, 72 aa, Homo sapiens
  Payload ID: 13943
  Gene Symbol: PNPO
  Gene Name: pyridoxamine 5'-phosphate oxidase
  ENSP ID: ENSP00000463520
MTCWLRGVTATFGRPAEWPGYLSHLCGRSAAMDLGPMRKSYRGDREVPPLGPGLLQGRGKRGPRSHLQRGGE

SEQ ID NO: 70206 - protein, 120 aa, Homo sapiens
  Payload ID: 13943
  Gene Symbol: PNPO
  Gene Name: pyridoxamine 5'-phosphate oxidase
  ENSP ID: ENSP00000463919
MCLATCTRDGKPSARMLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEV

SEQ ID NO: 70207 - protein, 46 aa, Homo sapiens
  Payload ID: 13943
  Gene Symbol: PNPO
  Gene Name: pyridoxamine 5'-phosphate oxidase
  ENSP ID: ENSP00000463972
MTCWLRGVTATFGRPAEWPGYLSHLCGRSAAMDLGPMRKSYRGDRE

SEQ ID NO: 70208 - protein, 69 aa, Homo sapiens; identical to SEQ ID NO: 70204
  Payload ID: 13943
  Gene Symbol: PNPO
  Gene Name: pyridoxamine 5'-phosphate oxidase
  ENSP ID: ENSP00000463994

SEQ ID NO: 70209 - protein, 365 aa, Homo sapiens
  Payload ID: 13944
  Gene Symbol: P2RY4
  Gene Name: pyrimidinergic receptor P2Y, G-protein coupled, 4
  Uniprot ID: P51582
  ENSP ID: ENSP00000363643
MASTESSLLRSLGLSPGPGSSEVELDCWFDEDFKFILLPVSYAVVFVLGLGLNAPTLWLFIFRLRPWDATATYMFHLALSDTLYVLSLPTLIYYYAAHNHWPFGTEICKFVRFLFYWNLYCSVLFLTCISVHRYLGICHPLRALRWGRPRLAGLLCLAVWLVVAGCLVPNLFFVTTSNKGTTVLCHDTTRPEEFDHYVHFSSAVMGLLFGVPCLVTLVCYGLMARRLYQPLPGSAQSSSRLRSLRTIAVVLTVFAVCFVPFHITRTIYYLARLLEADCRVLNIVNVVYKVTRPLASANSCLDPVLYLLTGDKYRRQLRQLCGGGKPQPRTAASSLALVSLPEDSSCRWAATPQDSSCSTPRADRL

SEQ ID NO: 70210 - protein, 328 aa, Homo sapiens
  Payload ID: 13945
  Gene Symbol: P2RY6
  Gene Name: pyrimidinergic receptor P2Y, G-protein coupled, 6
  Uniprot ID: Q15077
  ENSP ID: ENSP00000309771
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVAAAFAISFLPFHITKTAYLAVRSTPGVPCTVLEAFAAAYKGTRPFASANSVLDPILFYFTQKKFRRRPHELLQKLTAKWQRQGR

SEQ ID NO: 70211 - protein, 328 aa, Homo sapiens; identical to SEQ ID NO: 70210
  Payload ID: 13945
  Gene Symbol: P2RY6
  Gene Name: pyrimidinergic receptor P2Y, G-protein coupled, 6
  Uniprot ID: Q15077
  ENSP ID: ENSP00000377215

SEQ ID NO: 70212 - protein, 328 aa, Homo sapiens; identical to SEQ ID NO: 70210
  Payload ID: 13945
  Gene Symbol: P2RY6
  Gene Name: pyrimidinergic receptor P2Y, G-protein coupled, 6
  Uniprot ID: Q15077
  ENSP ID: ENSP00000377216

SEQ ID NO: 70213 - protein, 328 aa, Homo sapiens; identical to SEQ ID NO: 70210
  Payload ID: 13945
  Gene Symbol: P2RY6
  Gene Name: pyrimidinergic receptor P2Y, G-protein coupled, 6
  Uniprot ID: Q15077
  ENSP ID: ENSP00000377217

SEQ ID NO: 70214 - protein, 245 aa, Homo sapiens
  Payload ID: 13945
  Gene Symbol: P2RY6
  Gene Name: pyrimidinergic receptor P2Y, G-protein coupled, 6
  ENSP ID: ENSP00000440770
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVA

SEQ ID NO: 70215 - protein, 128 aa, Homo sapiens
  Payload ID: 13945
  Gene Symbol: P2RY6
  Gene Name: pyrimidinergic receptor P2Y, G-protein coupled, 6
  ENSP ID: ENSP00000441079
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGI

SEQ ID NO: 70216 - protein, 56 aa, Homo sapiens
  Payload ID: 13945
  Gene Symbol: P2RY6
  Gene Name: pyrimidinergic receptor P2Y, G-protein coupled, 6
  ENSP ID: ENSP00000442509
MEWDNGTGIQRNRTVCYDLSPPALATHYMPYGMALTVIGFLLPFAALLACYCLLAC

SEQ ID NO: 70217 - protein, 328 aa, Homo sapiens; identical to SEQ ID NO: 70210
  Payload ID: 13945
  Gene Symbol: P2RY6
  Gene Name: pyrimidinergic receptor P2Y, G-protein coupled, 6
  Uniprot ID: Q15077
  ENSP ID: ENSP00000442551

SEQ ID NO: 70218 - protein, 328 aa, Homo sapiens; identical to SEQ ID NO: 70210
  Payload ID: 13945
  Gene Symbol: P2RY6
  Gene Name: pyrimidinergic receptor P2Y, G-protein coupled, 6
  Uniprot ID: Q15077
  ENSP ID: ENSP00000442990

SEQ ID NO: 70219 - protein, 328 aa, Homo sapiens; identical to SEQ ID NO: 70210
  Payload ID: 13945
  Gene Symbol: P2RY6
  Gene Name: pyrimidinergic receptor P2Y, G-protein coupled, 6
  Uniprot ID: Q15077
  ENSP ID: ENSP00000443427

SEQ ID NO: 70220 - protein, 328 aa, Homo sapiens; identical to SEQ ID NO: 70210
  Payload ID: 13945
  Gene Symbol: P2RY6
  Gene Name: pyrimidinergic receptor P2Y, G-protein coupled, 6
  Uniprot ID: Q15077
  ENSP ID: ENSP00000445652

SEQ ID NO: 70221 - protein, 328 aa, Homo sapiens; identical to SEQ ID NO: 70210
  Payload ID: 13945
  Gene Symbol: P2RY6
  Gene Name: pyrimidinergic receptor P2Y, G-protein coupled, 6
  Uniprot ID: Q15077
  ENSP ID: ENSP00000480966

SEQ ID NO: 70222 - protein, 245 aa, Homo sapiens
  Payload ID: 13946
  Gene Symbol: PYHIN1
  Gene Name: pyrin and HIN domain family, member 1
  Uniprot ID: Q6K0P9
  ENSP ID: ENSP00000357117
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTEAYLMNLTLSLTAGSFLSCAVWGRDRELRNLELSATDSLSTAPIYYTPIPFAH

SEQ ID NO: 70223 - protein, 483 aa, Homo sapiens
  Payload ID: 13946
  Gene Symbol: PYHIN1
  Gene Name: pyrin and HIN domain family, member 1
  Uniprot ID: Q6K0P9
  ENSP ID: ENSP00000357120
MANNYKKIVLLKGLEVINDYHFRIVKSLLSNDLKLNPKMKEEYDKIQIADLMEEKFPGDAGLGKLIEFFKEIPTLGDLAETLKREKLKVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKKDETHPGAQSSPANFRITSPTVAPPLSSDTSTNRHPAVP

SEQ ID NO: 70224 - protein, 492 aa, Homo sapiens
  Payload ID: 13946
  Gene Symbol: PYHIN1
  Gene Name: pyrin and HIN domain family, member 1
  Uniprot ID: Q6K0P9
  ENSP ID: ENSP00000357122
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKKDETHPGAQSSPANFRITSPTVAPPLSSDTSTNRHPAVP

SEQ ID NO: 70225 - protein, 452 aa, Homo sapiens
  Payload ID: 13946
  Gene Symbol: PYHIN1
  Gene Name: pyrin and HIN domain family, member 1
  Uniprot ID: Q6K0P9
  ENSP ID: ENSP00000376082
MANNYKKIVLLKGLEVINDYHFRIVKSLLSNDLKLNPKMKEEYDKIQIADLMEEKFPGDAGLGKLIEFFKEIPTLGDLAETLKREKLKVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKVTKDKDIK

SEQ ID NO: 70226 - protein, 461 aa, Homo sapiens
  Payload ID: 13946
  Gene Symbol: PYHIN1
  Gene Name: pyrin and HIN domain family, member 1
  Uniprot ID: Q6K0P9
  ENSP ID: ENSP00000376083
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTKRSKMSKEQTRPSCSAGASTSTAMGRSPPPQTSSSAPPNTSSTESLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKVTKDKDIK

SEQ ID NO: 70227 - protein, 150 aa, Homo sapiens
  Payload ID: 13946
  Gene Symbol: PYHIN1
  Gene Name: pyrin and HIN domain family, member 1
  ENSP ID: ENSP00000407616
MANNYKKIVLLKGLEVINDYHFRIVKSLLSNDLKLNPKMKEEYDKIQIADLMEEKFPGDAGLGKLIEFFKEIPTLGDLAETLKREKLKVANKIESIPVKGIIPSKKTKQKEVYPATPACTPSNRLTAKGAEETLGPQKRKKPSEEETGTK

SEQ ID NO: 70228 - protein, 97 aa, Homo sapiens
  Payload ID: 13947
  Gene Symbol: PYDC2
  Gene Name: pyrin domain containing 2
  Uniprot ID: Q56P42
  ENSP ID: ENSP00000428325
MASSAELDFNLQALLEQLSQDELSKFKSLIRTISLGKELQTVPQTEVDKANGKQLVEIFTSHSCSYWAGMAAIQVFEKMNQTHLSGRADEHCVMPPP

SEQ ID NO: 70229 - protein, 136 aa, Homo sapiens
  Payload ID: 13948
  Gene Symbol: QRFP
  Gene Name: pyroglutamylated RFamide peptide
  Uniprot ID: P83859
  ENSP ID: ENSP00000345487
MVRPYPLIYFLFLPLGACFPLLDRREPTDAMGGLGAGERWADLAMGPRPHSVWGSSRWLRASQPQALLVIARGLQTSGREHAGCRFRFGRQDEGSEATGFLPAAGEKTSGPLGNLAEELNGYSRKKGGFSFRFGRR

SEQ ID NO: 70230 - protein, 136 aa, Homo sapiens; identical to SEQ ID NO: 70229
  Payload ID: 13948
  Gene Symbol: QRFP
  Gene Name: pyroglutamylated RFamide peptide
  Uniprot ID: P83859
  ENSP ID: ENSP00000485512

SEQ ID NO: 70231 - protein, 258 aa, Homo sapiens
  Payload ID: 13949
  Gene Symbol: QRFPR
  Gene Name: pyroglutamylated RFamide peptide receptor
  ENSP ID: ENSP00000335610
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMEEETSCHYDGDSGGSLCCVLGTIPCCPYDD

SEQ ID NO: 70232 - protein, 431 aa, Homo sapiens
  Payload ID: 13949
  Gene Symbol: QRFPR
  Gene Name: pyroglutamylated RFamide peptide receptor
  Uniprot ID: Q96P65
  ENSP ID: ENSP00000377948
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 70233 - protein, 190 aa, Homo sapiens
  Payload ID: 13949
  Gene Symbol: QRFPR
  Gene Name: pyroglutamylated RFamide peptide receptor
  ENSP ID: ENSP00000423369
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEALP

SEQ ID NO: 70234 - protein, 132 aa, Homo sapiens
  Payload ID: 13950
  Gene Symbol: PGPEP1
  Gene Name: pyroglutamyl-peptidase I
  Uniprot ID: Q9NXJ5
  ENSP ID: ENSP00000252813
MATTVTLEKCGHNKGYKGLDNCRFCPGSQCCVEDGPESIDSIIDMDAVCKRVTTLGLDVSVTISQDAGRYLCDFTYYTSLYQSHGRSAFVHVPPLGKPYNADQLGRALRAIIEEMLDLLEQSEGKINYCHKH

SEQ ID NO: 70235 - protein, 209 aa, Homo sapiens
  Payload ID: 13950
  Gene Symbol: PGPEP1
  Gene Name: pyroglutamyl-peptidase I
  Uniprot ID: Q9NXJ5
  ENSP ID: ENSP00000269919
MEQPRKAVVVTGFGPFGEHTVNASWIAVQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGRYLCDFTYYTSLYQSHGRSAFVHVPPLGKPYNADQLGRALRAIIEEMLDLLEQSEGKINYCHKH

SEQ ID NO: 70236 - protein, 89 aa, Homo sapiens
  Payload ID: 13950
  Gene Symbol: PGPEP1
  Gene Name: pyroglutamyl-peptidase I
  ENSP ID: ENSP00000468932
MEQPRKAVVVTGFGPFGEHTVNASWIAVQRWDLTILPWLVLNFRAQMILPPRPPKEAGIIGVSHRALPSGARKARPWRQRGPACVRDSG

SEQ ID NO: 70237 - protein, 89 aa, Homo sapiens; identical to SEQ ID NO: 70236
  Payload ID: 13950
  Gene Symbol: PGPEP1
  Gene Name: pyroglutamyl-peptidase I
  ENSP ID: ENSP00000470622

SEQ ID NO: 70238 - protein, 87 aa, Homo sapiens
  Payload ID: 13950
  Gene Symbol: PGPEP1
  Gene Name: pyroglutamyl-peptidase I
  ENSP ID: ENSP00000471130
EDGPESIDSIIDMDAVCKRVTTLGLDVSVTISQDAGSLGSQKSKVKVVAGLVPSGGAEGKNPSLPKVTVFSAAEGGPGPSRLSVASP

SEQ ID NO: 70239 - protein, 110 aa, Homo sapiens
  Payload ID: 13950
  Gene Symbol: PGPEP1
  Gene Name: pyroglutamyl-peptidase I
  ENSP ID: ENSP00000473226
  MOD_RES (1)..(1): Any amino acid
XFCPGSQCCVEDGPESIDSIIDMDAVCKRVTTLGLDVSVTISQDAGRKKPFPAKGDCVFCRRRRARSLQAQCGFSLTPALELLPVPFLKLLCPGPPRRRRICRILPGAGL

SEQ ID NO: 70240 - protein, 171 aa, Homo sapiens
  Payload ID: 13950
  Gene Symbol: PGPEP1
  Gene Name: pyroglutamyl-peptidase I
  ENSP ID: ENSP00000473772
MEQPRKAVVVTGFGPFGEHTVNASWIAVQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGRVTVDQPSSTCPHWGSRTTRTSWAGH

SEQ ID NO: 70241 - protein, 111 aa, Homo sapiens
  Payload ID: 13950
  Gene Symbol: PGPEP1
  Gene Name: pyroglutamyl-peptidase I
  ENSP ID: ENSP00000475477
MEQPRKAVVVTGFGPFGEHTVNASWIAVQELEKLGLGDSVDLHVYEIPVEYQTVQRLIPALWEKHSPQISLRLYLLHLFVPESRSISLRPRAPTGEAVQRGPAGQGTESHH

SEQ ID NO: 70242 - protein, 146 aa, Homo sapiens
  Payload ID: 13950
  Gene Symbol: PGPEP1
  Gene Name: pyroglutamyl-peptidase I
  ENSP ID: ENSP00000475867
MEQPRKAVVVTGFGPFGEHTVNASWIAVQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGR

SEQ ID NO: 70243 - protein, 196 aa, Homo sapiens
  Payload ID: 13951
  Gene Symbol: PGPEP1L
  Gene Name: pyroglutamyl-peptidase I-like
  Uniprot ID: A6NFU8
  ENSP ID: ENSP00000368199
MKPRTLVELSKLGLGNETVVQLRTLELPVDYREAKRRVTGIWEDHQPQLVVHVGMDTAAKAIILEQSGKNQGYRDADIRSFWPEGGVCLPGSPDVLESGVCMKAVCKRVAVEGVDVIFSRDAGRYVCDYTYYLSLHHGKGCAALIHVPPLSRGLPASLLGRALRVIIQEMLEEVGKPKHRAQFEENSTMVLPAKGN

SEQ ID NO: 70244 - protein, 142 aa, Homo sapiens
  Payload ID: 13951
  Gene Symbol: PGPEP1L
  Gene Name: pyroglutamyl-peptidase I-like
  Uniprot ID: A6NFU8
  ENSP ID: ENSP00000437560
MDTAAKAIILEQSGKNQGYRDADIRSFWPEGGVCLPGSPDVLESGVCMKAVCKRVAVEGVDVIFSRDAGRYVCDYTYYLSLHHGKGCAALIHVPPLSRGLPASLLGRALRVIIQEMLEEVGKPKHRAQFEENSTMVLPAKGN

SEQ ID NO: 70245 - protein, 178 aa, Homo sapiens
  Payload ID: 13952
  Gene Symbol: PPA1
  Gene Name: pyrophosphatase (inorganic) 1
  ENSP ID: ENSP00000362327
MSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNVCNSVVIL

SEQ ID NO: 70246 - protein, 289 aa, Homo sapiens
  Payload ID: 13952
  Gene Symbol: PPA1
  Gene Name: pyrophosphatase (inorganic) 1
  Uniprot ID: Q15181
  ENSP ID: ENSP00000362329
MSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 70247 - protein, 178 aa, Homo sapiens; identical to SEQ ID NO: 70245
  Payload ID: 13952
  Gene Symbol: PPA1
  Gene Name: pyrophosphatase (inorganic) 1
  ENSP ID: ENSP00000486162

SEQ ID NO: 70248 - protein, 55 aa, Homo sapiens
  Payload ID: 13953
  Gene Symbol: PPA2
  Gene Name: pyrophosphatase (inorganic) 2
  ENSP ID: ENSP00000273977
MSALLRLLRTGAPAAACLRLGTSAGTGSRRAMALYHTEERGQPCSQNYRLFFKSV

SEQ ID NO: 70249 - protein, 305 aa, Homo sapiens
  Payload ID: 13953
  Gene Symbol: PPA2
  Gene Name: pyrophosphatase (inorganic) 2
  Uniprot ID: Q9H2U2
  ENSP ID: ENSP00000313061
MSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 70250 - protein, 168 aa, Homo sapiens
  Payload ID: 13953
  Gene Symbol: PPA2
  Gene Name: pyrophosphatase (inorganic) 2
  Uniprot ID: Q9H2U2
  ENSP ID: ENSP00000340352
MSALLRLLRTGAPAAACLRLGTSAGTGSRRAMALYHTEERGQPCSQNYRLFFNIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 70251 - protein, 334 aa, Homo sapiens
  Payload ID: 13953
  Gene Symbol: PPA2
  Gene Name: pyrophosphatase (inorganic) 2
  Uniprot ID: Q9H2U2
  ENSP ID: ENSP00000343885
MSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 70252 - protein, 232 aa, Homo sapiens
  Payload ID: 13953
  Gene Symbol: PPA2
  Gene Name: pyrophosphatase (inorganic) 2
  Uniprot ID: Q9H2U2
  ENSP ID: ENSP00000389957
MSALLRLLRTGAPAAACLRLGTSAGTGSRRAMALYHTEERGQPCSQNYRLFFKNVTGHYISPFHDIPLKVNSKEILSCGEVIHVKILGILALIDEGETDWKLIAINANDPEASKFHDIDDVKKFKPGYLEATLNWFRLYKVPDGKPENQFAFNGEFKNKAFALEVIKSTHQCWKALLMKKCNGGAINCTNVQISDSPFRCTQEEARSLVESVSSSPNKESNEEEQVWHFLGK

SEQ ID NO: 70253 - protein, 195 aa, Homo sapiens
  Payload ID: 13953
  Gene Symbol: PPA2
  Gene Name: pyrophosphatase (inorganic) 2
  ENSP ID: ENSP00000421177
MSALLRLLRTGAPAAACLRLGTSAGTGSRRAMALYHTEERGQPCSQNYRLFFKNVTGHYISPFHDIPLKENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGET

SEQ ID NO: 70254 - protein, 42 aa, Homo sapiens
  Payload ID: 13953
  Gene Symbol: PPA2
  Gene Name: pyrophosphatase (inorganic) 2
  ENSP ID: ENSP00000422405
TSAGTGSRRAMALYHTEERGQPCSQNYRLFFRKWHSYEESTK

SEQ ID NO: 70255 - protein, 113 aa, Homo sapiens
  Payload ID: 13953
  Gene Symbol: PPA2
  Gene Name: pyrophosphatase (inorganic) 2
  ENSP ID: ENSP00000422738
MSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEVLKIAM

SEQ ID NO: 70256 - protein, 191 aa, Homo sapiens
  Payload ID: 13953
  Gene Symbol: PPA2
  Gene Name: pyrophosphatase (inorganic) 2
  ENSP ID: ENSP00000423363
MSALLRLLRTGAPAAACLRLGTSAGTGSRRAMALYHTEERGQPCSQNYRLFFKNVTGHYISPFHDIPLKVNSKETWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFNGEFKNKAFA

SEQ ID NO: 70257 - protein, 63 aa, Homo sapiens
  Payload ID: 13953
  Gene Symbol: PPA2
  Gene Name: pyrophosphatase (inorganic) 2
  ENSP ID: ENSP00000423467
MALYHTEERGQPCSQNYRLFFKNVTGHYISPFHDIPLKVNSKEDTEAQGIFIDLSKIWKMAFL

SEQ ID NO: 70258 - protein, 226 aa, Homo sapiens
  Payload ID: 13953
  Gene Symbol: PPA2
  Gene Name: pyrophosphatase (inorganic) 2
  ENSP ID: ENSP00000423889
  MOD_RES (1)..(1): Any amino acid
XLRLLRTGAPAAACLRLGTSAGTGSRRAMALYHTEERGQPCSQNYRLFFKNVTGHYISPFHDIPLKVNSKEENGIPMKKARNDEYEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGK

SEQ ID NO: 70259 - protein, 55 aa, Homo sapiens; identical to SEQ ID NO: 70248
  Payload ID: 13953
  Gene Symbol: PPA2
  Gene Name: pyrophosphatase (inorganic) 2
  ENSP ID: ENSP00000424988

SEQ ID NO: 70260 - protein, 88 aa, Homo sapiens
  Payload ID: 13953
  Gene Symbol: PPA2
  Gene Name: pyrophosphatase (inorganic) 2
  ENSP ID: ENSP00000426347
MKKARNDEYENLFNMIVEIPRWTNAKMEIATKEPMNPIKQYVKDGKLRYVANIFPYKGYIWNYGTLPQTWEDPHEKDKSTNCFGDNDP

SEQ ID NO: 70261 - protein, 69 aa, Homo sapiens
  Payload ID: 13953
  Gene Symbol: PPA2
  Gene Name: pyrophosphatase (inorganic) 2
  ENSP ID: ENSP00000427375
  MOD_RES (1)..(1): Any amino acid
XWTNAKMEIATKEPMNPIKQYVKDGKLRYVANIFPYKGYIWNYGTLPQVSSSPNKESNEEEQVWHFLGK

SEQ ID NO: 70262 - protein, 319 aa, Homo sapiens
  Payload ID: 13954
  Gene Symbol: PYCR1
  Gene Name: pyrroline-5-carboxylate reductase 1
  Uniprot ID: P32322
  ENSP ID: ENSP00000328858
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 70263 - protein, 316 aa, Homo sapiens
  Payload ID: 13954
  Gene Symbol: PYCR1
  Gene Name: pyrroline-5-carboxylate reductase 1
  Uniprot ID: P32322
  ENSP ID: ENSP00000336579
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKDHLPLELGSPEGLHPLLLQYQLARAPS

SEQ ID NO: 70264 - protein, 346 aa, Homo sapiens
  Payload ID: 13954
  Gene Symbol: PYCR1
  Gene Name: pyrroline-5-carboxylate reductase 1
  Uniprot ID: P32322
  ENSP ID: ENSP00000384949
MVGGGRRVGRDEPVPSVGALGQGSPDSMSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 70265 - protein, 288 aa, Homo sapiens
  Payload ID: 13954
  Gene Symbol: PYCR1
  Gene Name: pyrroline-5-carboxylate reductase 1
  ENSP ID: ENSP00000385483
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 70266 - protein, 253 aa, Homo sapiens
  Payload ID: 13954
  Gene Symbol: PYCR1
  Gene Name: pyrroline-5-carboxylate reductase 1
  ENSP ID: ENSP00000386002
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSL

SEQ ID NO: 70267 - protein, 109 aa, Homo sapiens
  Payload ID: 13954
  Gene Symbol: PYCR1
  Gene Name: pyrroline-5-carboxylate reductase 1
  ENSP ID: ENSP00000462398
MASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGT

SEQ ID NO: 70268 - protein, 84 aa, Homo sapiens
  Payload ID: 13954
  Gene Symbol: PYCR1
  Gene Name: pyrroline-5-carboxylate reductase 1
  ENSP ID: ENSP00000462892
MSVGFIGAGQLAFALAKGFTAAGVLAAHKIMASSPDMDLATVSALRKMGVKLTPHNKETVQHSDVLFLAVKPHIIPFILDEIGA

SEQ ID NO: 70269 - protein, 94 aa, Homo sapiens
  Payload ID: 13954
  Gene Symbol: PYCR1
  Gene Name: pyrroline-5-carboxylate reductase 1
  ENSP ID: ENSP00000463225
MSVGFIGAGQLAFALAKGFTAAGVLAAHKIMASSPDMDLATVSALRKMGVKLTPHNKETVQHSDVLFLAVKPHIIPFILDEIGADIEDRHIVVS

SEQ ID NO: 70270 - protein, 242 aa, Homo sapiens
  Payload ID: 13954
  Gene Symbol: PYCR1
  Gene Name: pyrroline-5-carboxylate reductase 1
  ENSP ID: ENSP00000463226
MASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMA

SEQ ID NO: 70271 - protein, 173 aa, Homo sapiens
  Payload ID: 13954
  Gene Symbol: PYCR1
  Gene Name: pyrroline-5-carboxylate reductase 1
  ENSP ID: ENSP00000463342
ALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYGAAVHG

SEQ ID NO: 70272 - protein, 225 aa, Homo sapiens
  Payload ID: 13954
  Gene Symbol: PYCR1
  Gene Name: pyrroline-5-carboxylate reductase 1
  ENSP ID: ENSP00000463343
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPG

SEQ ID NO: 70273 - protein, 217 aa, Homo sapiens
  Payload ID: 13954
  Gene Symbol: PYCR1
  Gene Name: pyrroline-5-carboxylate reductase 1
  ENSP ID: ENSP00000463352
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAVHG

SEQ ID NO: 70274 - protein, 165 aa, Homo sapiens
  Payload ID: 13954
  Gene Symbol: PYCR1
  Gene Name: pyrroline-5-carboxylate reductase 1
  ENSP ID: ENSP00000463601
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEED

SEQ ID NO: 70275 - protein, 132 aa, Homo sapiens
  Payload ID: 13954
  Gene Symbol: PYCR1
  Gene Name: pyrroline-5-carboxylate reductase 1
  ENSP ID: ENSP00000464098
MSVGFIGAGQLAFALAKGFTAAGVLAAHKIMASSPDMDLATVSALRLSAFRPAPRVIRCMTNTPVVVREGATVYATGTHAQVEDGRLMEQLLSSVGFCTEVEEDLIDAVTGLSGSGPAYAFTALDALADGGV

SEQ ID NO: 70276 - protein, 115 aa, Homo sapiens
  Payload ID: 13954
  Gene Symbol: PYCR1
  Gene Name: pyrroline-5-carboxylate reductase 1
  ENSP ID: ENSP00000464440
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAP

SEQ ID NO: 70277 - protein, 319 aa, Homo sapiens; identical to SEQ ID NO: 70262
  Payload ID: 13954
  Gene Symbol: PYCR1
  Gene Name: pyrroline-5-carboxylate reductase 1
  Uniprot ID: P32322
  ENSP ID: ENSP00000479793

SEQ ID NO: 70278 - protein, 217 aa, Homo sapiens; identical to SEQ ID NO: 70273
  Payload ID: 13954
  Gene Symbol: PYCR1
  Gene Name: pyrroline-5-carboxylate reductase 1
  ENSP ID: ENSP00000485679

SEQ ID NO: 70279 - protein, 320 aa, Homo sapiens
  Payload ID: 13955
  Gene Symbol: PYCR2
  Gene Name: pyrroline-5-carboxylate reductase family, member 2
  Uniprot ID: Q96C36
  ENSP ID: ENSP00000342502
MSVGFIGAGQLAYALARGFTAAGILSAHKIIASSPEMNLPTVSALRKMGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLIDAVTGLSGSGPAYAFMALDALADGGVKMGLPRRLAIQLGAQALLGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 70280 - protein, 246 aa, Homo sapiens
  Payload ID: 13955
  Gene Symbol: PYCR2
  Gene Name: pyrroline-5-carboxylate reductase family, member 2
  ENSP ID: ENSP00000478165
MSVGFIGAGQLAYALARGFTAAGILSAHKIIASSPEMNLPTVSALRKMGVNLTRSNKETVKHSDVLFLAVKPHIIPFILDEIGADVQARHIVVSCAAGVTISSVEKAFMALDALADGGVKMGLPRRLAIQLGAQALLGAAKMLLDSEQHPCQLKDNVCSPGGATIHALHFLESGGFRSLLINAVEASCIRTRELQSMADQEKISPAALKKTLLDRVKLESPTVSTLTPSSPGKLLTRSLALGGKKD

SEQ ID NO: 70281 - protein, 87 aa, Homo sapiens
  Payload ID: 13955
  Gene Symbol: PYCR2
  Gene Name: pyrroline-5-carboxylate reductase family, member 2
  ENSP ID: ENSP00000480779
MNLPTVSALRKMGVNLTRSNKETVKHSDVLFLAVKPHIIPFILDEIGADVQARHIVVSCAAGVTISSVEKKLMAFQPAPKVIRCMTN

SEQ ID NO: 70282 - protein, 157 aa, Homo sapiens
  Payload ID: 13955
  Gene Symbol: PYCR2
  Gene Name: pyrroline-5-carboxylate reductase family, member 2
  ENSP ID: ENSP00000482614
MNLPTVSALRKMGVNLTRSNKETVKHSDVLFLAVKPHIIPFILDEIGADVQARHIVVSCAAGVTISSVEKKLMAFQPAPKVIRCMTNTPVVVQEGATVYATGTHALVEDGQLLEQLMSSVGFCTEVEEDLIDAVTGLSGSGPAYAFMALDALADGGV

SEQ ID NO: 70283 - protein, 319 aa, Homo sapiens [sequence omitted]

SEQ ID NO: 70284 - protein, 286 aa, Homo sapiens
  Payload ID: 13956
  Gene Symbol: PYCRL
  Gene Name: pyrroline-5-carboxylate reductase-like
  ENSP ID: ENSP00000220966
MGGERSGVRGNKMAAAEPSPRRVGFVGAGRMAGAIAQGLIRAGKVEAQHILASAPTDRNLCHFQALGCRTTHSNQEVLQSCLLVIFATKPHVLPAVLAEVAPVVTTEHILVSVAAGVSLSTLEELLPPNTRVLRVLPNLPCVVQEGAIVMARGRHVGSSETKLLQHLLEACGRCEEVPEAYVDIHTGLSGSGVAFVCAFSEALAEGAVKMGMPSSLAHRIAAQTLLGTAKMLLHEGQHPAQLRSDVCTPGGTTIYGLHALEQGGLRAATMSAVEAATCRAKELSRK

SEQ ID NO: 70285 - protein, 137 aa, Homo sapiens
  Payload ID: 13956
  Gene Symbol: PYCRL
  Gene Name: pyrroline-5-carboxylate reductase-like
  ENSP ID: ENSP00000366802
MARGRHVGSSETKLLQHLLEACGRCEEVPEAYVDIHTGLSGSGVAFVCAFSEALAEGAVKMGMPSSLAHRIAAQTLLGTAKMLLHEGQHPAQLRSDVCTPGGTTIYGLHALEQGGLRAATMSAVEAATCRAKELSRK

SEQ ID NO: 70286 - protein, 44 aa, Homo sapiens
  Payload ID: 13956
  Gene Symbol: PYCRL
  Gene Name: pyrroline-5-carboxylate reductase-like
  ENSP ID: ENSP00000401804
MAAAEPSPRRVGFVGAGRMAGAIAQGLIRAAILQGPEESRSIGK

SEQ ID NO: 70287 - protein, 254 aa, Homo sapiens
  Payload ID: 13956
  Gene Symbol: PYCRL
  Gene Name: pyrroline-5-carboxylate reductase-like
  Uniprot ID: Q53H96
  ENSP ID: ENSP00000404493
MAAAEPSPRRVGFVGAGRMAGAIAQGLIRAGKVEAQHILASAPTDRNLCHFQALGCRTTHSNQEVLQSCLLVIFATKPHVLPAVLAEVAPVVTTEHILVSVAAGVSLSTLEEEGAIVMARGRHVGSSETKLLQHLLEACGRCEEVPEAYVDIHTGLSGSGVAFVCAFSEALAEGAVKMGMPSSLAHRIAAQTLLGTAKMLLHEGQHPAQLRSDVCTPGGTTIYGLHALEQGGLRAATMSAVEAATCRAKELSRK

SEQ ID NO: 70288 - protein, 59 aa, Homo sapiens
  Payload ID: 13956
  Gene Symbol: PYCRL
  Gene Name: pyrroline-5-carboxylate reductase-like
  ENSP ID: ENSP00000478138
MARGRHVGSSETKLLQHLLEACGRCEEVPEAYVDIHTGLSGSGVAFVCAFSEALAEGAV

SEQ ID NO: 70289 - protein, 274 aa, Homo sapiens
  Payload ID: 13956
  Gene Symbol: PYCRL
  Gene Name: pyrroline-5-carboxylate reductase-like
  Uniprot ID: Q53H96
  ENSP ID: ENSP00000480945
MAAAEPSPRRVGFVGAGRMAGAIAQGLIRAGKVEAQHILASAPTDRNLCHFQALGCRTTHSNQEVLQSCLLVIFATKPHVLPAVLAEVAPVVTTEHILVSVAAGVSLSTLEELLPPNTRVLRVLPNLPCVVQEGAIVMARGRHVGSSETKLLQHLLEACGRCEEVPEAYVDIHTGLSGSGVAFVCAFSEALAEGAVKMGMPSSLAHRIAAQTLLGTAKMLLHEGQHPAQLRSDVCTPGGTTIYGLHALEQGGLRAATMSAVEAATCRAKELSRK

SEQ ID NO: 70290 - protein, 286 aa, Homo sapiens; identical to SEQ ID NO: 70284
  Payload ID: 13956
  Gene Symbol: PYCRL
  Gene Name: pyrroline-5-carboxylate reductase-like
  ENSP ID: ENSP00000484458

SEQ ID NO: 70291 - protein, 137 aa, Homo sapiens; identical to SEQ ID NO: 70285
  Payload ID: 13956
  Gene Symbol: PYCRL
  Gene Name: pyrroline-5-carboxylate reductase-like
  ENSP ID: ENSP00000487676

SEQ ID NO: 70292 - protein, 274 aa, Homo sapiens; identical to SEQ ID NO: 70289
  Payload ID: 13956
  Gene Symbol: PYCRL
  Gene Name: pyrroline-5-carboxylate reductase-like
  Uniprot ID: Q53H96
  ENSP ID: ENSP00000488371

SEQ ID NO: 70293 - protein, 44 aa, Homo sapiens; identical to SEQ ID NO: 70286
  Payload ID: 13956
  Gene Symbol: PYCRL
  Gene Name: pyrroline-5-carboxylate reductase-like
  ENSP ID: ENSP00000488701

SEQ ID NO: 70294 - protein, 59 aa, Homo sapiens; identical to SEQ ID NO: 70288
  Payload ID: 13956
  Gene Symbol: PYCRL
  Gene Name: pyrroline-5-carboxylate reductase-like
  ENSP ID: ENSP00000488777

SEQ ID NO: 70295 - protein, 254 aa, Homo sapiens; identical to SEQ ID NO: 70287
  Payload ID: 13956
  Gene Symbol: PYCRL
  Gene Name: pyrroline-5-carboxylate reductase-like
  Uniprot ID: Q53H96
  ENSP ID: ENSP00000488877

SEQ ID NO: 70296 - protein, 1178 aa, Homo sapiens
  Payload ID: 13957
  Gene Symbol: PC
  Gene Name: pyruvate carboxylase
  Uniprot ID: P11498
  ENSP ID: ENSP00000377527
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 70297 - protein, 1178 aa, Homo sapiens; identical to SEQ ID NO: 70296
  Payload ID: 13957
  Gene Symbol: PC
  Gene Name: pyruvate carboxylase
  Uniprot ID: P11498
  ENSP ID: ENSP00000377530

SEQ ID NO: 70298 - protein, 1178 aa, Homo sapiens; identical to SEQ ID NO: 70296
  Payload ID: 13957
  Gene Symbol: PC
  Gene Name: pyruvate carboxylase
  Uniprot ID: P11498
  ENSP ID: ENSP00000377532

SEQ ID NO: 70299 - protein, 489 aa, Homo sapiens
  Payload ID: 13957
  Gene Symbol: PC
  Gene Name: pyruvate carboxylase
  ENSP ID: ENSP00000434192
MVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKVRRHQAQPLAAALGRPCGQEARRPQAAVTAPTGPGSPTLVRVPPAARVLSSRLGGPSQTTPETSTEVSPTILL

SEQ ID NO: 70300 - protein, 298 aa, Homo sapiens [sequence omitted]

SEQ ID NO: 70301 - protein, 489 aa, Homo sapiens; identical to SEQ ID NO: 70299
  Payload ID: 13957
  Gene Symbol: PC
  Gene Name: pyruvate carboxylase
  ENSP ID: ENSP00000486373

SEQ ID NO: 70302 - protein, 203 aa, Homo sapiens
  Payload ID: 13958
  Gene Symbol: PDHA1
  Gene Name: pyruvate dehydrogenase (lipoamide) alpha 1
  ENSP ID: ENSP00000348062
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQFLLPLTQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGD

SEQ ID NO: 70303 - protein, 109 aa, Homo sapiens
  Payload ID: 13958
  Gene Symbol: PDHA1
  Gene Name: pyruvate dehydrogenase (lipoamide) alpha 1
  ENSP ID: ENSP00000369132
MELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 70304 - protein, 180 aa, Homo sapiens
  Payload ID: 13958
  Gene Symbol: PDHA1
  Gene Name: pyruvate dehydrogenase (lipoamide) alpha 1
  ENSP ID: ENSP00000369133
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVVKDEDCVLL

SEQ ID NO: 70305 - protein, 428 aa, Homo sapiens
  Payload ID: 13958
  Gene Symbol: PDHA1
  Gene Name: pyruvate dehydrogenase (lipoamide) alpha 1
  Uniprot ID: P08559
  ENSP ID: ENSP00000369134
MRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 70306 - protein, 390 aa, Homo sapiens
  Payload ID: 13958
  Gene Symbol: PDHA1
  Gene Name: pyruvate dehydrogenase (lipoamide) alpha 1
  Uniprot ID: P08559
  ENSP ID: ENSP00000394382
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 70307 - protein, 121 aa, Homo sapiens
  Payload ID: 13958
  Gene Symbol: PDHA1
  Gene Name: pyruvate dehydrogenase (lipoamide) alpha 1
  ENSP ID: ENSP00000404616
MRKMLAAVSRVLSGASQKPFAGSPPPRHLTVGRKLSSRYEVTFESAQASRVLVASRNFANDATFEIKKCDLHRLEEGPPVTTVLTREDGLKYYRMMQTVRRMELKADQLYKQKIIRGFCHL

SEQ ID NO: 70308 - protein, 205 aa, Homo sapiens
  Payload ID: 13958
  Gene Symbol: PDHA1
  Gene Name: pyruvate dehydrogenase (lipoamide) alpha 1
  ENSP ID: ENSP00000406473
MRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIV

SEQ ID NO: 70309 - protein, 397 aa, Homo sapiens
  Payload ID: 13958
  Gene Symbol: PDHA1
  Gene Name: pyruvate dehydrogenase (lipoamide) alpha 1
  Uniprot ID: P08559
  ENSP ID: ENSP00000438550
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQFLLPLTQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 70310 - protein, 359 aa, Homo sapiens
  Payload ID: 13958
  Gene Symbol: PDHA1
  Gene Name: pyruvate dehydrogenase (lipoamide) alpha 1
  Uniprot ID: P08559
  ENSP ID: ENSP00000440761
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 70311 - protein, 388 aa, Homo sapiens
  Payload ID: 13959
  Gene Symbol: PDHA2
  Gene Name: pyruvate dehydrogenase (lipoamide) alpha 2
  Uniprot ID: P29803
  ENSP ID: ENSP00000295266
MLAAFISRVLRRVAQKSARRVLVASRNSSNDATFEIKKCDLYLLEEGPPVTTVLTRAEGLKYYRMMLTVRRMELKADQLYKQKFIRGFCHLCDGQEACCVGLEAGINPSDHVITSYRAHGVCYTRGLSVRSILAELTGRRGGCAKGKGGSMHMYTKNFYGGNGIVGAQGPLGAGIALACKYKGNDEICLTLYGDGAANQGQIAEAFNMAALWKLPCVFICENNLYGMGTSTERAAASPDYYKRGNFIPGLKVDGMDVLCVREATKFAANYCRSGKGPILMELQTYRYHGHSMSDPGVSYRTREEIQEVRSKRDPIIILQDRMVNSKLATVEELKEIGAEVRKEIDDAAQFATTDPEPHLEELGHHIYSSDSSFEVRGANPWIKFKSVS

SEQ ID NO: 70312 - protein, 359 aa, Homo sapiens
  Payload ID: 13960
  Gene Symbol: PDHB
  Gene Name: pyruvate dehydrogenase (lipoamide) beta
  Uniprot ID: P11177
  ENSP ID: ENSP00000307241
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 70313 - protein, 341 aa, Homo sapiens
  Payload ID: 13960
  Gene Symbol: PDHB
  Gene Name: pyruvate dehydrogenase (lipoamide) beta
  Uniprot ID: P11177
  ENSP ID: ENSP00000373220
MAAVSGLVRRPLREVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 70314 - protein, 341 aa, Homo sapiens
  Payload ID: 13960
  Gene Symbol: PDHB
  Gene Name: pyruvate dehydrogenase (lipoamide) beta
  Uniprot ID: P11177
  ENSP ID: ENSP00000417267
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 70315 - protein, 350 aa, Homo sapiens
  Payload ID: 13960
  Gene Symbol: PDHB
  Gene Name: pyruvate dehydrogenase (lipoamide) beta
  ENSP ID: ENSP00000418448
MAAVSGLVRRPLREVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGISKKLVLEYSQAIVNIMYLNTYRIKRLKARSGQTTSTLNLSCVQFPGCSCCSCHWC

SEQ ID NO: 70316 - protein, 251 aa, Homo sapiens
  Payload ID: 13960
  Gene Symbol: PDHB
  Gene Name: pyruvate dehydrogenase (lipoamide) beta
  ENSP ID: ENSP00000419580
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGRLPHSSAHWNEVELKTL

SEQ ID NO: 70317 - protein, 501 aa, Homo sapiens
  Payload ID: 13961
  Gene Symbol: PDHX
  Gene Name: pyruvate dehydrogenase complex, component X
  Uniprot ID: O00330
  ENSP ID: ENSP00000227868
MAASWRLGCDPRLLRYLVGFPGRRSVGLVKGALGWSVSRGANWRWFHSTQWLRGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 70318 - protein, 486 aa, Homo sapiens
  Payload ID: 13961
  Gene Symbol: PDHX
  Gene Name: pyruvate dehydrogenase complex, component X
  Uniprot ID: O00330
  ENSP ID: ENSP00000389404
MQSGGAEGSPGAGRTGRGPGSGKAPPAEISSGAPDFPGGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 70319 - protein, 274 aa, Homo sapiens
  Payload ID: 13961
  Gene Symbol: PDHX
  Gene Name: pyruvate dehydrogenase complex, component X
  Uniprot ID: O00330
  ENSP ID: ENSP00000415695
MAASWRLGCDPRLLRYLVGFPGRRSVGLVKGALGWSVSRGANWRWFHSTQWLRGDPIKILMPSLSPTMEEGNIVKWLKKEGEAVSAGDALCEIETDKAVVTLDASDDGILAKIVQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 70320 - protein, 151 aa, Homo sapiens
  Payload ID: 13961
  Gene Symbol: PDHX
  Gene Name: pyruvate dehydrogenase complex, component X
  ENSP ID: ENSP00000431281
MPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIF

SEQ ID NO: 70321 - protein, 182 aa, Homo sapiens
  Payload ID: 13961
  Gene Symbol: PDHX
  Gene Name: pyruvate dehydrogenase complex, component X
  ENSP ID: ENSP00000432277
MAASWRLGCDPRLLRYLVGFPGRRSVGLVKGALGWSVSRGANWRWFHSTQWLRGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRG

SEQ ID NO: 70322 - protein, 189 aa, Homo sapiens
  Payload ID: 13961
  Gene Symbol: PDHX
  Gene Name: pyruvate dehydrogenase complex, component X
  ENSP ID: ENSP00000433204
  MOD_RES (1)..(1): Any amino acid
XHLSFSRHRNDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 70323 - protein, 436 aa, Homo sapiens
  Payload ID: 13962
  Gene Symbol: PDK1
  Gene Name: pyruvate dehydrogenase kinase, isozyme 1
  Uniprot ID: Q15118
  ENSP ID: ENSP00000282077
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 70324 - protein, 456 aa, Homo sapiens
  Payload ID: 13962
  Gene Symbol: PDK1
  Gene Name: pyruvate dehydrogenase kinase, isozyme 1
  Uniprot ID: Q15118
  ENSP ID: ENSP00000376352
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYERPRRTWLQVSSLCCMACKMIFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 70325 - protein, 436 aa, Homo sapiens; identical to SEQ ID NO: 70323
  Payload ID: 13962
  Gene Symbol: PDK1
  Gene Name: pyruvate dehydrogenase kinase, isozyme 1
  Uniprot ID: Q15118
  ENSP ID: ENSP00000386985

SEQ ID NO: 70326 - protein, 154 aa, Homo sapiens
  Payload ID: 13962
  Gene Symbol: PDK1
  Gene Name: pyruvate dehydrogenase kinase, isozyme 1
  ENSP ID: ENSP00000388366
MFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIK

SEQ ID NO: 70327 - protein, 229 aa, Homo sapiens
  Payload ID: 13962
  Gene Symbol: PDK1
  Gene Name: pyruvate dehydrogenase kinase, isozyme 1
  ENSP ID: ENSP00000399160
MKQFLDFGSVNACEKTSFMFLRQELPVRLANIMKEISLLPDNLLRTPSVQLVQSCFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNED

SEQ ID NO: 70328 - protein, 154 aa, Homo sapiens; identical to SEQ ID NO: 70326
  Payload ID: 13962
  Gene Symbol: PDK1
  Gene Name: pyruvate dehydrogenase kinase, isozyme 1
  ENSP ID: ENSP00000399558

SEQ ID NO: 70329 - protein, 62 aa, Homo sapiens
  Payload ID: 13962
  Gene Symbol: PDK1
  Gene Name: pyruvate dehydrogenase kinase, isozyme 1
  ENSP ID: ENSP00000406608
MFLRQELPVRLANIMKEISLLPDNLLRTPSVQLVQSWYIQSLQELLDFKDKSAEDAKAIYEE

SEQ ID NO: 70330 - protein, 164 aa, Homo sapiens
  Payload ID: 13962
  Gene Symbol: PDK1
  Gene Name: pyruvate dehydrogenase kinase, isozyme 1
  ENSP ID: ENSP00000413629
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFIVWWKRQRKSISSKTHWKHKSKLQCT

SEQ ID NO: 70331 - protein, 343 aa, Homo sapiens
  Payload ID: 13963
  Gene Symbol: PDK2
  Gene Name: pyruvate dehydrogenase kinase, isozyme 2
  Uniprot ID: Q15119
  ENSP ID: ENSP00000007708
MKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 70332 - protein, 407 aa, Homo sapiens
  Payload ID: 13963
  Gene Symbol: PDK2
  Gene Name: pyruvate dehydrogenase kinase, isozyme 2
  Uniprot ID: Q15119
  ENSP ID: ENSP00000420927
MRWVWALLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 70333 - protein, 98 aa, Homo sapiens
  Payload ID: 13963
  Gene Symbol: PDK2
  Gene Name: pyruvate dehydrogenase kinase, isozyme 2
  ENSP ID: ENSP00000421178
MKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSR

SEQ ID NO: 70334 - protein, 160 aa, Homo sapiens
  Payload ID: 13963
  Gene Symbol: PDK2
  Gene Name: pyruvate dehydrogenase kinase, isozyme 2
  ENSP ID: ENSP00000423310
MEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKN

SEQ ID NO: 70335 - protein, 259 aa, Homo sapiens
  Payload ID: 13963
  Gene Symbol: PDK2
  Gene Name: pyruvate dehydrogenase kinase, isozyme 2
  ENSP ID: ENSP00000425265
MKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPL

SEQ ID NO: 70336 - protein, 141 aa, Homo sapiens
  Payload ID: 13963
  Gene Symbol: PDK2
  Gene Name: pyruvate dehydrogenase kinase, isozyme 2
  ENSP ID: ENSP00000425615
MKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAY

SEQ ID NO: 70337 - protein, 129 aa, Homo sapiens
  Payload ID: 13963
  Gene Symbol: PDK2
  Gene Name: pyruvate dehydrogenase kinase, isozyme 2
  ENSP ID: ENSP00000427682
MKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDP

SEQ ID NO: 70338 - protein, 343 aa, Homo sapiens; identical to SEQ ID NO: 70331
  Payload ID: 13963
  Gene Symbol: PDK2
  Gene Name: pyruvate dehydrogenase kinase, isozyme 2
  Uniprot ID: Q15119
  ENSP ID: ENSP00000481915

SEQ ID NO: 70339 - protein, 406 aa, Homo sapiens
  Payload ID: 13964
  Gene Symbol: PDK3
  Gene Name: pyruvate dehydrogenase kinase, isozyme 3
  Uniprot ID: Q15120
  ENSP ID: ENSP00000368460
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQ

SEQ ID NO: 70340 - protein, 415 aa, Homo sapiens
  Payload ID: 13964
  Gene Symbol: PDK3
  Gene Name: pyruvate dehydrogenase kinase, isozyme 3
  Uniprot ID: Q15120
  ENSP ID: ENSP00000387536
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQDKIKTNRTF

SEQ ID NO: 70341 - protein, 411 aa, Homo sapiens
  Payload ID: 13965
  Gene Symbol: PDK4
  Gene Name: pyruvate dehydrogenase kinase, isozyme 4
  Uniprot ID: Q16654
  ENSP ID: ENSP00000005178
MKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKISDRGGGVPLRIIDRLFSYTYSTAPTPVMDNSRNAPLAGFGYGLPISRLYAKYFQGDLNLYSLSGYGTDAIIYLKALSSESIEKLPVFNKSAFKHYQMSSEADDWCIPSREPKNLAKEVAM

SEQ ID NO: 70342 - protein, 879 aa, Homo sapiens
  Payload ID: 13966
  Gene Symbol: PDPR
  Gene Name: pyruvate dehydrogenase phosphatase regulatory subunit
  Uniprot ID: Q8NCN5
  ENSP ID: ENSP00000288050
MMFYRLLSIVGRQRASPGWQNWSSARNSTSAAEARSMALPTQAQVVICGGGITGTSVAYHLSKMGWKDIVLLEQGRLAAGSTRFCAGILSTARHLTIEQKMADYSNKLYYQLEQETGIQTGYTRTGSIFLAQTQDRLISLKRINAGLNVIGIPSEIISPKKVAELHHLLNVHDLVGAMHVPEDAVVSSADVALALASAASQNGVQIYDRTSVLHVMVKKGQVTGVETDKGQIECQYFVNCAGQWAYELGLSNEEPVSIPLHACEHFYLLTRPLETPLQSSTPTIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRVMEVMPLMYDLKVPRWDFQTGRQLRTSPLYDRLDAQGARWMEKHGFERPKYFVPPDKDLLALEQSKTFYKPDWFDIVESEVKCCKEAVCVIDMSSFTKFEITSTGDQALEVLQYLFSNDLDVPVGHIVHTGMLNEGGGYENDCSIARLNKRSFFMISPTDQQVHCWAWLKKHMPKDSNLLLEDVTWKYTALNLIGPRAVDVLSELSYAPMTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDLHGK

SEQ ID NO: 70343 - protein, 779 aa, Homo sapiens
  Payload ID: 13966
  Gene Symbol: PDPR
  Gene Name: pyruvate dehydrogenase phosphatase regulatory subunit
  ENSP ID: ENSP00000381190
MADYSNKLYYQLEQETGIQTGYTRTGSIFLAQTQDRLISLKRINAGLNVIGIPSEIISPKKVAELHHLLNVHDLVGAMHVPEDAVVSSADVALALASAASQNGVQIYDRTSVLHVMVKKGQVTGVETDKGQIECQYFVNCAGQWAYELGLSNEEPVSIPLHACEHFYLLTRPLETPLQSSTPTIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRVMEVMPLMYDLKVPRWDFQTGRQLRTSPLYDRLDAQGARWMEKHGFERPKYFVPPDKDLLALEQSKTFYKPDWFDIVESEVKCCKEAVCVIDMSSFTKFEITSTGDQALEVLQYLFSNDLDVPVGHIVHTGMLNEGGGYENDCSIARLNKRSFFMISPTDQQVHCWAWLKKHMPKDSNLLLEDVTWKYTALNLIGPRAVDVLSELSYAPMTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDLHGK

SEQ ID NO: 70344 - protein, 491 aa, Homo sapiens
  Payload ID: 13966
  Gene Symbol: PDPR
  Gene Name: pyruvate dehydrogenase phosphatase regulatory subunit
  ENSP ID: ENSP00000455764
MMFYRLLSIVGRQRASPGWQNWSSARNSTSAAEARSMALPTQAQVVICGGGITGTSVAYHLSKMGWKDIVLLEQGRLAAGSTRFCAGILSTARHLTIEQKMADYSNKLYYQLEQETGIQTGYTRTGSIFLAQTQDRLISLKRINAGLNVIGIPSEIISPKKVAELHHLLNVHDLVGAMHVPEDAVVSSADVALALASAASQNGVQIYDRTSVLHVMVKKGQVTGVETDKGQIECQYFVNCAGQWAYELGLSNEEPVSIPLHACEHFYLLTRPLETPLQSSTPTIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRVMEVMPLMYDLKVPRWDFQTGRQLRTSPLYDRLDAQGARWMEKHGFERPKYFVPPDKG

SEQ ID NO: 70345 - protein, 37 aa, Homo sapiens
  Payload ID: 13966
  Gene Symbol: PDPR
  Gene Name: pyruvate dehydrogenase phosphatase regulatory subunit
  ENSP ID: ENSP00000456385
MTPDHFPSLFCKWQPQLSETNCNRMKAMTTESSPGSC

SEQ ID NO: 70346 - protein, 237 aa, Homo sapiens
  Payload ID: 13966
  Gene Symbol: PDPR
  Gene Name: pyruvate dehydrogenase phosphatase regulatory subunit
  ENSP ID: ENSP00000456959
MTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDLHGK

SEQ ID NO: 70347 - protein, 100 aa, Homo sapiens
  Payload ID: 13966
  Gene Symbol: PDPR
  Gene Name: pyruvate dehydrogenase phosphatase regulatory subunit
  ENSP ID: ENSP00000457484
MTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVK

SEQ ID NO: 70348 - protein, 197 aa, Homo sapiens
  Payload ID: 13966
  Gene Symbol: PDPR
  Gene Name: pyruvate dehydrogenase phosphatase regulatory subunit
  ENSP ID: ENSP00000457636
MLSLSTLNLIGPRAVDVLSELSYAPMTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCL

SEQ ID NO: 70349 - protein, 879 aa, Homo sapiens; identical to SEQ ID NO: 70342
  Payload ID: 13966
  Gene Symbol: PDPR
  Gene Name: pyruvate dehydrogenase phosphatase regulatory subunit
  Uniprot ID: Q8NCN5
  ENSP ID: ENSP00000457916

SEQ ID NO: 70350 - protein, 149 aa, Homo sapiens
  Payload ID: 13966
  Gene Symbol: PDPR
  Gene Name: pyruvate dehydrogenase phosphatase regulatory subunit
  ENSP ID: ENSP00000457961
MTPDHFPSLFCKEMSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYR

SEQ ID NO: 70351 - protein, 537 aa, Homo sapiens
  Payload ID: 13967
  Gene Symbol: PDP1
  Gene Name: pyruvate dehyrogenase phosphatase catalytic subunit 1
  Uniprot ID: Q9P0J1
  ENSP ID: ENSP00000297598
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCACSQAVSERLFYYIAVSLLPHETLLEIENAVESGRALLPILQWHKHPNDYFSKEASKLYFNSLRTYWQELIDLNTGESTDIDVKEALINAFKRLDNDISLEAQVGDPNSFLNYLVLRVAFSGATACVAHVDGVDLHVANTGDSRAMLGVQEEDGSWSAVTLSNDHNAQNERELERLKLEHPKSEAKSVVKQDRLLGLLMPFRAFGDVKFKWSIDLQKRVIESGPDQLNDNEYTKFIPPNYHTPPYLTAEPEVTYHRLRPQDKFLVLATDGLWETMHRQDVVRIVGEYLTGMHHQQPIAVGGYKVTLGQMHGLLTERRTKMSSVFEDQNAATHLIRHAVGNNEFGTVDHERLSKMLSLPEELARMYRDDITIIVVQFNSHVVGAYQNQE

SEQ ID NO: 70352 - protein, 562 aa, Homo sapiens
  Payload ID: 13967
  Gene Symbol: PDP1
  Gene Name: pyruvate dehyrogenase phosphatase catalytic subunit 1
  Uniprot ID: Q9P0J1
  ENSP ID: ENSP00000379503
MCVCPGPRRIGIPVRSSSLPLFSDAMPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCACSQAVSERLFYYIAVSLLPHETLLEIENAVESGRALLPILQWHKHPNDYFSKEASKLYFNSLRTYWQELIDLNTGESTDIDVKEALINAFKRLDNDISLEAQVGDPNSFLNYLVLRVAFSGATACVAHVDGVDLHVANTGDSRAMLGVQEEDGSWSAVTLSNDHNAQNERELERLKLEHPKSEAKSVVKQDRLLGLLMPFRAFGDVKFKWSIDLQKRVIESGPDQLNDNEYTKFIPPNYHTPPYLTAEPEVTYHRLRPQDKFLVLATDGLWETMHRQDVVRIVGEYLTGMHHQQPIAVGGYKVTLGQMHGLLTERRTKMSSVFEDQNAATHLIRHAVGNNEFGTVDHERLSKMLSLPEELARMYRDDITIIVVQFNSHVVGAYQNQE

SEQ ID NO: 70353 - protein, 537 aa, Homo sapiens; identical to SEQ ID NO: 70351
  Payload ID: 13967
  Gene Symbol: PDP1
  Gene Name: pyruvate dehyrogenase phosphatase catalytic subunit 1
  Uniprot ID: Q9P0J1
  ENSP ID: ENSP00000428317

SEQ ID NO: 70354 - protein, 128 aa, Homo sapiens
  Payload ID: 13967
  Gene Symbol: PDP1
  Gene Name: pyruvate dehyrogenase phosphatase catalytic subunit 1
  ENSP ID: ENSP00000428433
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRS

SEQ ID NO: 70355 - protein, 147 aa, Homo sapiens
  Payload ID: 13967
  Gene Symbol: PDP1
  Gene Name: pyruvate dehyrogenase phosphatase catalytic subunit 1
  ENSP ID: ENSP00000429492
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHA

SEQ ID NO: 70356 - protein, 76 aa, Homo sapiens
  Payload ID: 13967
  Gene Symbol: PDP1
  Gene Name: pyruvate dehyrogenase phosphatase catalytic subunit 1
  ENSP ID: ENSP00000430366
MPAPTQLFFPLIRNCELSRIYGTACYCHHKHLCCSSSYIPQSRLRYTPHPAYATFCRPKENWWQYTQGRRYASTPQ

SEQ ID NO: 70357 - protein, 537 aa, Homo sapiens; identical to SEQ ID NO: 70351
  Payload ID: 13967
  Gene Symbol: PDP1
  Gene Name: pyruvate dehyrogenase phosphatase catalytic subunit 1
  Uniprot ID: Q9P0J1
  ENSP ID: ENSP00000430380

SEQ ID NO: 70358 - protein, 232 aa, Homo sapiens
  Payload ID: 13967
  Gene Symbol: PDP1
  Gene Name: pyruvate dehyrogenase phosphatase catalytic subunit 1
  ENSP ID: ENSP00000430655
MPAPTQLFFPLIRNCELSRIYGTACYCHHKHLCCSSSYIPQSRLRYTPHPAYATFCRPKENWWQYTQGRRYASTPQKFYLTPPQVNSILKANEYSFKVPEFDGKNVSSILGFDSNQLPANAPIEDRRSAATCLQTRGMLLGVFDGHAGCACSQAVSERLFYYIAVSLLPHETLLEIENAVESGRALLPILQWHKHPNDYFSKEASKLYFNSLRTYWQELIDLNTGESTDIDV

SEQ ID NO: 70359 - protein, 72 aa, Homo sapiens
  Payload ID: 13967
  Gene Symbol: PDP1
  Gene Name: pyruvate dehyrogenase phosphatase catalytic subunit 1
  ENSP ID: ENSP00000430931
MPAPTQLFFPLIRNCELSRIYGTACYCHHKHLCCSSSYIPQSRLRYTPHPAYATFCRPKENWWQYTQGRRYA

SEQ ID NO: 70360 - protein, 529 aa, Homo sapiens
  Payload ID: 13968
  Gene Symbol: PDP2
  Gene Name: pyruvate dehyrogenase phosphatase catalytic subunit 2
  Uniprot ID: Q9P2J9
  ENSP ID: ENSP00000309548
MSSTVSYWILNSTRNSIATLQGGRRLYSRYVSNRNKLKWRLFSRVPPTLNSSPCGGFTLCKAYRHTSTEEDDFHLQLSPEQINEVLRAGETTHKILDLESRVPNSVLRFESNQLAANSPVEDRRGVASCLQTNGLMFGIFDGHGGHACAQAVSERLFYYVAVSLMSHQTLEHMEGAMESMKPLLPILHWLKHPGDSIYKDVTSVHLDHLRVYWQELLDLHMEMGLSIEEALMYSFQRLDSDISLEIQAPLEDEVTRNLSLQVAFSGATACMAHVDGIHLHVANAGDCRAILGVQEDNGMWSCLPLTRDHNAWNQAELSRLKREHPESEDRTIIMEDRLLGVLIPCRAFGDVQLKWSKELQRSILERGFNTEALNIYQFTPPHYYTPPYLTAEPEVTYHRLRPQDKFLVLASDGLWDMLSNEDVVRLVVGHLAEADWHKTDLAQRPANLGLMQSLLLQRKASGLHEADQNAATRLIRHAIGNNEYGEMEAERLAAMLTLPEDLARMYRDDITVTVVYFNSESIGAYYKGG

SEQ ID NO: 70361 - protein, 242 aa, Homo sapiens
  Payload ID: 13968
  Gene Symbol: PDP2
  Gene Name: pyruvate dehyrogenase phosphatase catalytic subunit 2
  ENSP ID: ENSP00000455975
MSSTVSYWILNSTRNSIATLQGGRRLYSRYVSNRNKLKWRLFSRVPPTLNSSPCGGFTLCKAYRHTSTEEDDFHLQLSPEQINEVLRAGETTHKILDLESRVPNSVLRFESNQLAANSPVEDRRGVASCLQTNGLMFGIFDGHGGHACAQAVSERLFYYVAVSLMSHQTLEHMEGAMESMKPLLPILHWLKHPGDSIYKDVTSVHLDHLRVYWQELLDLHMEMGLSIEEALMYSFQRLDSDI

SEQ ID NO: 70362 - protein, 27 aa, Homo sapiens
  Payload ID: 13968
  Gene Symbol: PDP2
  Gene Name: pyruvate dehyrogenase phosphatase catalytic subunit 2
  ENSP ID: ENSP00000456171
MSSTVSYWILNSTRNSIATLQGGRRLY

SEQ ID NO: 70363 - protein, 155 aa, Homo sapiens
  Payload ID: 13968
  Gene Symbol: PDP2
  Gene Name: pyruvate dehyrogenase phosphatase catalytic subunit 2
  ENSP ID: ENSP00000456611
MSSTVSYWILNSTRNSIATLQGGRRLYSRYVSNRNKLKWRLFSRVPPTLNSSPCGGFTLCKAYRHTSTEEDDFHLQLSPEQINEVLRAGETTHKILDLESRVPNSVLRFESNQLAANSPVEDRRGVASCLQTNGLMFGIFDGHGGHACAQAVSER

SEQ ID NO: 70364 - protein, 151 aa, Homo sapiens
  Payload ID: 13968
  Gene Symbol: PDP2
  Gene Name: pyruvate dehyrogenase phosphatase catalytic subunit 2
  ENSP ID: ENSP00000457331
MSSTVSYWILNSTRNSIATLQGGRRLYSRYVSNRNKLKWRLFSRVPPTLNSSPCGGFTLCKAYRHTSTEEDDFHLQLSPEQINEVLRAGETTHKILDLESRVPNSVLRFESNQLAANSPVEDRRGVASCLQTNGLMFGIFDGHGGHACAQA

SEQ ID NO: 70365 - protein, 103 aa, Homo sapiens
  Payload ID: 13968
  Gene Symbol: PDP2
  Gene Name: pyruvate dehyrogenase phosphatase catalytic subunit 2
  ENSP ID: ENSP00000457951
MSSTVSYWILNSTRNSIATLQGGRRLYSRYVSNRNKLKWRLFSRVPPTLNSSPCGGFTLCKAYRHTSTEEDDFHLQLSPEQINEVLRAGETTHKILDLESRVP

SEQ ID NO: 70366 - protein, 574 aa, Homo sapiens
  Payload ID: 13969
  Gene Symbol: PKLR
  Gene Name: pyruvate kinase, liver and RBC
  Uniprot ID: P30613
  ENSP ID: ENSP00000339933
MSIQENISSLQLRSWVSKSQRDLAKSILIGAPGGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 70367 - protein, 543 aa, Homo sapiens
  Payload ID: 13969
  Gene Symbol: PKLR
  Gene Name: pyruvate kinase, liver and RBC
  Uniprot ID: P30613
  ENSP ID: ENSP00000376214
MEGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 70368 - protein, 46 aa, Homo sapiens
  Payload ID: 13969
  Gene Symbol: PKLR
  Gene Name: pyruvate kinase, liver and RBC
  ENSP ID: ENSP00000398037
MPLTTQQCGADPQRGRPREVCSGMEAAAAASCYGRHLPGTPLPTGH

SEQ ID NO: 70369 - protein, 46 aa, Homo sapiens; identical to SEQ ID NO: 70368
  Payload ID: 13969
  Gene Symbol: PKLR
  Gene Name: pyruvate kinase, liver and RBC
  ENSP ID: ENSP00000459447

SEQ ID NO: 70370 - protein, 574 aa, Homo sapiens; identical to SEQ ID NO: 70366
  Payload ID: 13969
  Gene Symbol: PKLR
  Gene Name: pyruvate kinase, liver and RBC
  Uniprot ID: P30613
  ENSP ID: ENSP00000459921

SEQ ID NO: 70371 - protein, 543 aa, Homo sapiens; identical to SEQ ID NO: 70367
  Payload ID: 13969
  Gene Symbol: PKLR
  Gene Name: pyruvate kinase, liver and RBC
  Uniprot ID: P30613
  ENSP ID: ENSP00000461487

SEQ ID NO: 70372 - protein, 531 aa, Homo sapiens
  Payload ID: 13970
  Gene Symbol: PKM
  Gene Name: pyruvate kinase, muscle
  Uniprot ID: P14618
  ENSP ID: ENSP00000320171
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 70373 - protein, 531 aa, Homo sapiens
  Payload ID: 13970
  Gene Symbol: PKM
  Gene Name: pyruvate kinase, muscle
  Uniprot ID: P14618
  ENSP ID: ENSP00000334983
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 70374 - protein, 457 aa, Homo sapiens
  Payload ID: 13970
  Gene Symbol: PKM
  Gene Name: pyruvate kinase, muscle
  ENSP ID: ENSP00000373745
MSKPHSEAGTAFIQTQQLHAAMADTFLEHMCRLDIDSPPITARNTGIICTIGPASRSVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 70375 - protein, 516 aa, Homo sapiens
  Payload ID: 13970
  Gene Symbol: PKM
  Gene Name: pyruvate kinase, muscle
  Uniprot ID: P14618
  ENSP ID: ENSP00000403365
MSPEAQPQRTKGPQQPCRSPIVKPGLPSFRPSSCTQPWLTHSWSTCAAWTLIHHPSQPGTLASSVPLYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 70376 - protein, 51 aa, Homo sapiens
  Payload ID: 13970
  Gene Symbol: PKM
  Gene Name: pyruvate kinase, muscle
  ENSP ID: ENSP00000454668
MSKPHSEAGTAFIQTQQLHAAMADTFLEHMCRLDIDSPPITARNTGIICTI

SEQ ID NO: 70377 - protein, 281 aa, Homo sapiens
  Payload ID: 13970
  Gene Symbol: PKM
  Gene Name: pyruvate kinase, muscle
  ENSP ID: ENSP00000455584
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRQV

SEQ ID NO: 70378 - protein, 531 aa, Homo sapiens; identical to SEQ ID NO: 70372
  Payload ID: 13970
  Gene Symbol: PKM
  Gene Name: pyruvate kinase, muscle
  Uniprot ID: P14618
  ENSP ID: ENSP00000455736

SEQ ID NO: 70379 - protein, 531 aa, Homo sapiens; identical to SEQ ID NO: 70372
  Payload ID: 13970
  Gene Symbol: PKM
  Gene Name: pyruvate kinase, muscle
  Uniprot ID: P14618
  ENSP ID: ENSP00000455901

SEQ ID NO: 70380 - protein, 69 aa, Homo sapiens
  Payload ID: 13970
  Gene Symbol: PKM
  Gene Name: pyruvate kinase, muscle
  ENSP ID: ENSP00000456004
MSKPHSEAGTAFIQTQQLHAAMADTFLEHMCRLDIDSPPITARNTGIICTIVPCGDHQECAHSHGKLCF

SEQ ID NO: 70381 - protein, 366 aa, Homo sapiens
  Payload ID: 13970
  Gene Symbol: PKM
  Gene Name: pyruvate kinase, muscle
  ENSP ID: ENSP00000456100
MSKPHSEAGTAFIQTQQLHAAMADTFLEHMCRLDIDSPPIKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 70382 - protein, 531 aa, Homo sapiens; identical to SEQ ID NO: 70372
  Payload ID: 13970
  Gene Symbol: PKM
  Gene Name: pyruvate kinase, muscle
  Uniprot ID: P14618
  ENSP ID: ENSP00000456970

SEQ ID NO: 70383 - protein, 151 aa, Homo sapiens
  Payload ID: 13970
  Gene Symbol: PKM
  Gene Name: pyruvate kinase, muscle
  ENSP ID: ENSP00000456984
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEK

SEQ ID NO: 70384 - protein, 168 aa, Homo sapiens
  Payload ID: 13970
  Gene Symbol: PKM
  Gene Name: pyruvate kinase, muscle
  ENSP ID: ENSP00000457198
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVV

SEQ ID NO: 70385 - protein, 485 aa, Homo sapiens
  Payload ID: 13970
  Gene Symbol: PKM
  Gene Name: pyruvate kinase, muscle
  ENSP ID: ENSP00000457253
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAMFHRKLFEELVRASSHSTDLMEAMAMGSVEASYKCLAAALIVLTESGRSAHQVARYRPRAPIIAVTRNPQTARQAHLYRGIFPVLCKDPVQEAWAED

SEQ ID NO: 70386 - protein, 82 aa, Homo sapiens
  Payload ID: 13970
  Gene Symbol: PKM
  Gene Name: pyruvate kinase, muscle
  ENSP ID: ENSP00000457420
MSKPHSEAGTAFIQTQQLHAAMADTFLEHMCRLDIDSPPITARNTGIICTIGPASRSVETLKEMIKSGMNVARLNFSHGTHE

SEQ ID NO: 70387 - protein, 162 aa, Homo sapiens
  Payload ID: 13970
  Gene Symbol: PKM
  Gene Name: pyruvate kinase, muscle
  ENSP ID: ENSP00000457830
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYK

SEQ ID NO: 70388 - protein, 325 aa, Homo sapiens
  Payload ID: 13971
  Gene Symbol: QKI
  Gene Name: QKI, KH domain containing, RNA binding
  Uniprot ID: Q96PU8
  ENSP ID: ENSP00000275262
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLEWIEMPVMPDISAH

SEQ ID NO: 70389 - protein, 333 aa, Homo sapiens
  Payload ID: 13971
  Gene Symbol: QKI
  Gene Name: QKI, KH domain containing, RNA binding
  Uniprot ID: Q96PU8
  ENSP ID: ENSP00000354867
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPTAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 70390 - protein, 319 aa, Homo sapiens
  Payload ID: 13971
  Gene Symbol: QKI
  Gene Name: QKI, KH domain containing, RNA binding
  Uniprot ID: Q96PU8
  ENSP ID: ENSP00000354951
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGMAFPTKG

SEQ ID NO: 70391 - protein, 341 aa, Homo sapiens
  Payload ID: 13971
  Gene Symbol: QKI
  Gene Name: QKI, KH domain containing, RNA binding
  Uniprot ID: Q96PU8
  ENSP ID: ENSP00000355094
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 70392 - protein, 319 aa, Homo sapiens
  Payload ID: 13971
  Gene Symbol: QKI
  Gene Name: QKI, KH domain containing, RNA binding
  Uniprot ID: Q96PU8
  ENSP ID: ENSP00000375973
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGKFFSPWG

SEQ ID NO: 70393 - protein, 317 aa, Homo sapiens
  Payload ID: 13971
  Gene Symbol: QKI
  Gene Name: QKI, KH domain containing, RNA binding
  Uniprot ID: Q96PU8
  ENSP ID: ENSP00000408382
MVGEMETKEKPKPTPDYLMQLMNDKKLMSSLPNFCGIFNHLERLLDEEISRVRKDMYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPTAQAAPRIITGPAPVLPPAALRTPTPAGPTIMPLIRQIQTAVMPNGTPHPTAAIVPPGPEAGLIYTPYEYPYTLAPATSILEYPIEPSGVLEWIEMPVMPDISAH

SEQ ID NO: 70394 - protein, 319 aa, Homo sapiens; identical to SEQ ID NO: 70390
  Payload ID: 13971
  Gene Symbol: QKI
  Gene Name: QKI, KH domain containing, RNA binding
  Uniprot ID: Q96PU8
  ENSP ID: ENSP00000408775

SEQ ID NO: 70395 - protein, 34 aa, Homo sapiens
  Payload ID: 13971
  Gene Symbol: QKI
  Gene Name: QKI, KH domain containing, RNA binding
  ENSP ID: ENSP00000437867
  MOD_RES (1)..(1): Any amino acid
XDYLMQLMNDKKLMSSLPNFCGIFNHLERLLDEV

SEQ ID NO: 70396 - protein, 170 aa, Homo sapiens
  Payload ID: 13971
  Gene Symbol: QKI
  Gene Name: QKI, KH domain containing, RNA binding
  ENSP ID: ENSP00000440599
MYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPALAFSLAATAQAA

SEQ ID NO: 70397 - protein, 160 aa, Homo sapiens
  Payload ID: 13971
  Gene Symbol: QKI
  Gene Name: QKI, KH domain containing, RNA binding
  ENSP ID: ENSP00000440991
MYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLITVEDAQNRAEIKLKRAVEEVKKLLVPAAEGEDSLKKMQLMELAILNGTYRDANIKSPTAQ

SEQ ID NO: 70398 - protein, 41 aa, Homo sapiens
  Payload ID: 13971
  Gene Symbol: QKI
  Gene Name: QKI, KH domain containing, RNA binding
  ENSP ID: ENSP00000441252
MYNDTLNGSTEKRSAELPDAVGPIVQLQEKLYVPVKEYPDL

SEQ ID NO: 70399 - protein, 238 aa, Homo sapiens
  Payload ID: 13971
  Gene Symbol: QKI
  Gene Name: QKI, KH domain containing, RNA binding
  ENSP ID: ENSP00000441773
  MOD_RES (1)..(1): Any amino acid
XEKRSAELPDAVGPIVQLQEKLYVPVKEYPDEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 70400 - protein, 185 aa, Homo sapiens
  Payload ID: 13971
  Gene Symbol: QKI
  Gene Name: QKI, KH domain containing, RNA binding
  ENSP ID: ENSP00000442848
  MOD_RES (1)..(1): Any amino acid
XLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRVTMATVQKILSNLRI

SEQ ID NO: 70401 - protein, 47 aa, Homo sapiens
  Payload ID: 13971
  Gene Symbol: QKI
  Gene Name: QKI, KH domain containing, RNA binding
  ENSP ID: ENSP00000443106
MYNDTLNGSTEKRSAELPDAVGPIVQLQEKLYVPVKEYPDFNFVGRI

SEQ ID NO: 70402 - protein, 100 aa, Homo sapiens
  Payload ID: 13971
  Gene Symbol: QKI
  Gene Name: QKI, KH domain containing, RNA binding
  ENSP ID: ENSP00000443690
MYNDTLNGSTEKRSAELPDAVGPIVQLQEKLYVPVKEYPDFNFVGRILGPRGLTAKQLEAETGCKIMVRGKGSMRDKKKEEQNRGKPNWEHLNEDLHVLI

SEQ ID NO: 70403 - protein, 403 aa, Homo sapiens
  Payload ID: 13972
  Gene Symbol: QTRT1
  Gene Name: queuine tRNA-ribosyltransferase 1
  Uniprot ID: Q9BXR0
  ENSP ID: ENSP00000250237
MAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 70404 - protein, 225 aa, Homo sapiens
  Payload ID: 13972
  Gene Symbol: QTRT1
  Gene Name: queuine tRNA-ribosyltransferase 1
  Uniprot ID: Q9BXR0
  ENSP ID: ENSP00000389126
MAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRPLGLVTGALLQVNPLAGPVHCSPSAAGQAEPLRHYPGWAGRRSPGHLP

SEQ ID NO: 70405 - protein, 203 aa, Homo sapiens
  Payload ID: 13972
  Gene Symbol: QTRT1
  Gene Name: queuine tRNA-ribosyltransferase 1
  ENSP ID: ENSP00000464990
  MOD_RES (1)..(1): Any amino acid
XGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALALLCHPGWSAVAQSWLTATSVSQIQAILLSLPSKQLGIQARTSSCSWTTWLAVL

SEQ ID NO: 70406 - protein, 136 aa, Homo sapiens
  Payload ID: 13972
  Gene Symbol: QTRT1
  Gene Name: queuine tRNA-ribosyltransferase 1
  ENSP ID: ENSP00000465974
DLVVCVALGCDMFDCVFPTRTARFGSALVPTGNLQLRKKVFEKDFGPIDPECTCPTCQKHSRAFLHALLHSDNTAALHHLTVHNIAYQLMSAVRTSIVEKRFPDFVRDFMGAMYGDPTLCPTWATDALASVGITLG

SEQ ID NO: 70407 - protein, 124 aa, Homo sapiens
  Payload ID: 13972
  Gene Symbol: QTRT1
  Gene Name: queuine tRNA-ribosyltransferase 1
  ENSP ID: ENSP00000467394
  MOD_RES (1)..(1): Any amino acid
XDIIMQLDDVVSSTVTGPRVEEAMYRSIRWLDRCIAAHQRPDKQNLFAIIQGGLDADLRATCLEGPQSESLKSRTLAGYHSSHLNPSTLGGQEMTKRDVPGFAIGGLSGGESKSQFWRMVALST

SEQ ID NO: 70408 - protein, 180 aa, Homo sapiens
  Payload ID: 13972
  Gene Symbol: QTRT1
  Gene Name: queuine tRNA-ribosyltransferase 1
  ENSP ID: ENSP00000468811
  MOD_RES (1)..(1): Any amino acid
XATQASLESAPRIMRLVAECSRSRARAGELWLPHGTVATPVFMPVGTQATMKGITTEQLDALGCRICLGNTYHLGLRPGPELIQKANGLHGFMNWPHNLLTVTEEGVRFRSPYDGNETLLSPEKSVQIQNALGSDIIMQLDDVVSSTVTGPRVEEAMYRSIRWLDRCIAAHQRPDKQNLF

SEQ ID NO: 70409 - protein, 415 aa, Homo sapiens
  Payload ID: 13973
  Gene Symbol: QTRTD1
  Gene Name: queuine tRNA-ribosyltransferase domain containing 1
  Uniprot ID: Q9H974
  ENSP ID: ENSP00000281273
MKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 70410 - protein, 292 aa, Homo sapiens
  Payload ID: 13973
  Gene Symbol: QTRTD1
  Gene Name: queuine tRNA-ribosyltransferase domain containing 1
  Uniprot ID: Q9H974
  ENSP ID: ENSP00000418056
MTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 70411 - protein, 9 aa, Homo sapiens
  Payload ID: 13973
  Gene Symbol: QTRTD1
  Gene Name: queuine tRNA-ribosyltransferase domain containing 1
  ENSP ID: ENSP00000418180
FEINLKEKK

SEQ ID NO: 70412 - protein, 309 aa, Homo sapiens
  Payload ID: 13973
  Gene Symbol: QTRTD1
  Gene Name: queuine tRNA-ribosyltransferase domain containing 1
  Uniprot ID: Q9H974
  ENSP ID: ENSP00000419169
MVCWQSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 70413 - protein, 145 aa, Homo sapiens
  Payload ID: 13973
  Gene Symbol: QTRTD1
  Gene Name: queuine tRNA-ribosyltransferase domain containing 1
  ENSP ID: ENSP00000419655
MKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKVLQKSVIIGVIEGGDVMEERLRSARETAKRPVGG

SEQ ID NO: 70414 - protein, 427 aa, Homo sapiens
  Payload ID: 13973
  Gene Symbol: QTRTD1
  Gene Name: queuine tRNA-ribosyltransferase domain containing 1
  Uniprot ID: Q9H974
  ENSP ID: ENSP00000420682
MVCWQDLEESLRMKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 70415 - protein, 167 aa, Homo sapiens
  Payload ID: 13973
  Gene Symbol: QTRTD1
  Gene Name: queuine tRNA-ribosyltransferase domain containing 1
  ENSP ID: ENSP00000420806
MKSNIYEDLEESLRMKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKSVSVWSVAGRVEMTVSKFMAIQKALQPDWFQCLSDGEVSCKE

SEQ ID NO: 70416 - protein, 604 aa, Homo sapiens
  Payload ID: 13974
  Gene Symbol: QSOX1
  Gene Name: quiescin Q6 sulfhydryl oxidase 1
  Uniprot ID: O00391
  ENSP ID: ENSP00000356572
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPELI

SEQ ID NO: 70417 - protein, 747 aa, Homo sapiens
  Payload ID: 13974
  Gene Symbol: QSOX1
  Gene Name: quiescin Q6 sulfhydryl oxidase 1
  Uniprot ID: O00391
  ENSP ID: ENSP00000356574
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 70418 - protein, 155 aa, Homo sapiens
  Payload ID: 13974
  Gene Symbol: QSOX1
  Gene Name: quiescin Q6 sulfhydryl oxidase 1
  ENSP ID: ENSP00000375883
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPGWRRLMDSLREITKSTWL

SEQ ID NO: 70419 - protein, 72 aa, Homo sapiens
  Payload ID: 13974
  Gene Symbol: QSOX1
  Gene Name: quiescin Q6 sulfhydryl oxidase 1
  ENSP ID: ENSP00000402170
  MOD_RES (1)..(1): Any amino acid
XNEQEQPLGQWHLSKRDTGAALLAESRAEKNRLWGPLEVRRVGRSSKQLVDIPEGQLEARAGRGRGQWLQLI

SEQ ID NO: 70420 - protein, 698 aa, Homo sapiens
  Payload ID: 13975
  Gene Symbol: QSOX2
  Gene Name: quiescin Q6 sulfhydryl oxidase 2
  Uniprot ID: Q6ZRP7
  ENSP ID: ENSP00000351536
MAAAGAAVARSPGIGAGPALRARRSPPPRAARLPRLLVLLAAAAVGPGAGGAARLYRAGEDAVWVLDSGSVRGATANSSAAWLVQFYSSWCGHCIGYAPTWRALAGDVRDWASAIRVAALDCMEEKNQAVCHDYDIHFYPTFRYFKAFTKEFTTGENFKGPDRELRTVRQTMIDFLQNHTEGSRPPACPRLDPIQPSDVLSLLDNRGSHYVAIVFESNSSYLGREVILDLIPYESIVVTRALDGDKAFLEKLGVSSVPSCYLIYPNGSHGLINVVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLAGHLSEDPRFPKLQWPTPDLCPACHEEIKGLASWDEGHVLTFLKQHYGRDNLLDTYSADQGDSSEGGTLARGEEEEKRLTPPEVSHGDRDTQSVRPPGALGPRPALPESLHHSLDGKLQSLDGPGAHKEVGGAAPFLGVDFSSLDMSLCVVLYVASSLFLMVMYFFFRVRSRRWKVKHHHPAV

SEQ ID NO: 70421 - protein, 284 aa, Homo sapiens
  Payload ID: 13975
  Gene Symbol: QSOX2
  Gene Name: quiescin Q6 sulfhydryl oxidase 2
  ENSP ID: ENSP00000389089
  MOD_RES (1)..(1): Any amino acid
XGENFKGPDRELRTVRQTMIDFLQNHTEGSRPPACPRLDPIHVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLA

SEQ ID NO: 70422 - protein, 696 aa, Homo sapiens
  Payload ID: 13975
  Gene Symbol: QSOX2
  Gene Name: quiescin Q6 sulfhydryl oxidase 2
  ENSP ID: ENSP00000483961
MAAAGAAVARSPGIGAGPALRARRSPPPRAARLPRLLVLLAAAAVGPGAGGAARLYRAGEDAVWVLDSGSVRGATANSSAAWLVQFYSSWCGHCIGYAPTWRALAGDVRDWASAIRVAALDCMEEKNQAVCHDYDIHFYPTFRYFKAFTKEFTTGENFKGPDRELRTVRQTMIDFLQNHTEGSRPPACPRLDPIQPSDVLSLLDNRGSHYVAIVFESNSSYLGREVILDLIPYESIVVTRALDGDKAFLEKLGVSSVPSCYLIYPNGSHGLINVVKPLRAFFSSYLKSLPDVRKKSLPLPEKPHKEENSEIVVWREFDKSKLYTVDLESGLHYLLRVELAAHKSLAGAELKTLKDFCLGQAVPWTAAVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLAGHLSEDPRFPKLQWPTPDLCPACHEEIKGLASWDEGHVLTFLKQHYGRDNLLDTYSADQGDSSEGGTLARGEEEEKRLTPPEVSHGDRDTQSVRPPGALGPRPALPESLHHSLDGKLQSLDGPGAHKEVGGAAPFLGVDFSSLDMSLCVVLYVASSLFLMVMYFFFRVRSRRWKVKHHHPAV

SEQ ID NO: 70423 - protein, 244 aa, Homo sapiens
  Payload ID: 13976
  Gene Symbol: QDPR
  Gene Name: quinoid dihydropteridine reductase
  Uniprot ID: P09417
  ENSP ID: ENSP00000281243
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 70424 - protein, 213 aa, Homo sapiens
  Payload ID: 13976
  Gene Symbol: QDPR
  Gene Name: quinoid dihydropteridine reductase
  Uniprot ID: P09417
  ENSP ID: ENSP00000390944
MAAAAAAGEARRVLVYGGRGALGSRCVQAFRARNWVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 70425 - protein, 128 aa, Homo sapiens
  Payload ID: 13976
  Gene Symbol: QDPR
  Gene Name: quinoid dihydropteridine reductase
  ENSP ID: ENSP00000420873
  MOD_RES (1)..(1): Any amino acid
XCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGLPWIPR

SEQ ID NO: 70426 - protein, 152 aa, Homo sapiens
  Payload ID: 13976
  Gene Symbol: QDPR
  Gene Name: quinoid dihydropteridine reductase
  ENSP ID: ENSP00000422759
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGLPWIPR

SEQ ID NO: 70427 - protein, 152 aa, Homo sapiens; identical to SEQ ID NO: 70426
  Payload ID: 13976
  Gene Symbol: QDPR
  Gene Name: quinoid dihydropteridine reductase
  ENSP ID: ENSP00000423227

SEQ ID NO: 70428 - protein, 36 aa, Homo sapiens
  Payload ID: 13976
  Gene Symbol: QDPR
  Gene Name: quinoid dihydropteridine reductase
  ENSP ID: ENSP00000426039
MAAAAAAGEARRVLVYGGRGALGSRCVQAFRARNWI

SEQ ID NO: 70429 - protein, 162 aa, Homo sapiens
  Payload ID: 13976
  Gene Symbol: QDPR
  Gene Name: quinoid dihydropteridine reductase
  ENSP ID: ENSP00000426377
MAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPELSMTGSQGKTDRAQEA

SEQ ID NO: 70430 - protein, 297 aa, Homo sapiens
  Payload ID: 13977
  Gene Symbol: QPRT
  Gene Name: quinolinate phosphoribosyltransferase
  Uniprot ID: Q15274
  ENSP ID: ENSP00000378782
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMVKDNHVVAAGGVEKAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 70431 - protein, 149 aa, Homo sapiens
  Payload ID: 13977
  Gene Symbol: QPRT
  Gene Name: quinolinate phosphoribosyltransferase
  ENSP ID: ENSP00000455183
MDAEGLALLLPPVTLAALVDSWLREDCPGLNYAALAVRAARQAADFTLKVEVECSSLQEAVQAAEAGADLVLLDNFKPEELHPTATVLKAQFPSVAVEASGGITLDNLPQFCGPHIDVISMGMLTQAAPALDFSLKLFAKEVAPVPKIH

SEQ ID NO: 70432 - protein, 440 aa, Homo sapiens
  Payload ID: 13978
  Gene Symbol: R3HCC1
  Gene Name: R3H domain and coiled-coil containing 1
  ENSP ID: ENSP00000265806
LALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRRQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKLLRLVKERPQTNATVARRLVARALGLQHKKKERPAVRGPLPP

SEQ ID NO: 70433 - protein, 480 aa, Homo sapiens
  Payload ID: 13978
  Gene Symbol: R3HCC1
  Gene Name: R3H domain and coiled-coil containing 1
  Uniprot ID: Q9Y3T6
  ENSP ID: ENSP00000397555
MNMKASRVTLGEAGARARWPLGTPRAAATRREAAALPPVTLALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRRQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKLLRLVKERPQTNATVARRLVARALGLQHKKKERPAVRGPLPP

SEQ ID NO: 70434 - protein, 283 aa, Homo sapiens
  Payload ID: 13978
  Gene Symbol: R3HCC1
  Gene Name: R3H domain and coiled-coil containing 1
  ENSP ID: ENSP00000428395
LALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRRQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQ

SEQ ID NO: 70435 - protein, 311 aa, Homo sapiens
  Payload ID: 13978
  Gene Symbol: R3HCC1
  Gene Name: R3H domain and coiled-coil containing 1
  ENSP ID: ENSP00000429417
LALLCLDGVFLSSAENDFVHRIQEELDRFLLQKQLSNRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRRQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVV

SEQ ID NO: 70436 - protein, 223 aa, Homo sapiens
  Payload ID: 13978
  Gene Symbol: R3HCC1
  Gene Name: R3H domain and coiled-coil containing 1
  ENSP ID: ENSP00000429604
LALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRRQEEWGLTSTSVLKREAPAGRDPEEPGDVGAGDPNSDQGLPVLMTQGTEDLKGPGQRCENEPLLDPVGPEPLGPESQSG

SEQ ID NO: 70437 - protein, 148 aa, Homo sapiens
  Payload ID: 13978
  Gene Symbol: R3HCC1
  Gene Name: R3H domain and coiled-coil containing 1
  ENSP ID: ENSP00000430339
EEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKTMVRDFRHEFSMTSK

SEQ ID NO: 70438 - protein, 398 aa, Homo sapiens
  Payload ID: 13978
  Gene Symbol: R3HCC1
  Gene Name: R3H domain and coiled-coil containing 1
  ENSP ID: ENSP00000486278
LALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRQEEWGLTSTSVLKREAPAGRDPEEPGDVGAGDPNSDQGLPVLMTQGTEDLKGPGQRCENEPLLDPVGPEPLGPESQSGKGDMVEMATRFGSTLQLDLEKGKESLLEKRLVAEEEEDEEEVEEDGPSSCSEDDYSELLQEITDNLTKKEIQIEKIHLDTSSFVEELPGEKDLAHVVEIYDFEPALKTEDLLATFSEFQEKGFRIQWVDDTHALGIFPCLASAAEALTREFSVLKIRPLTQGTKQSKLKALQRPKLLRLVKERPQTNATVARRLVARALGLQHKKKERPAVRGPLPP

SEQ ID NO: 70439 - protein, 43 aa, Homo sapiens
  Payload ID: 13978
  Gene Symbol: R3HCC1
  Gene Name: R3H domain and coiled-coil containing 1
  ENSP ID: ENSP00000486624
LALLCLDGVFLSSAENDFVHRIQEELDRFLLQKQLSKVLLFPP

SEQ ID NO: 70440 - protein, 201 aa, Homo sapiens
  Payload ID: 13978
  Gene Symbol: R3HCC1
  Gene Name: R3H domain and coiled-coil containing 1
  ENSP ID: ENSP00000487121
LALLCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPSRYHGPRPISNQGAAAVPRGARAGRWYRGRKPDQPLYVPRVLRRQEEWGLTSTSVLKREAPAGRDPEEPGDVGAGDPNSDQGLPVLMTQGTEDLKGPGQS

SEQ ID NO: 70441 - protein, 778 aa, Homo sapiens
  Payload ID: 13979
  Gene Symbol: R3HCC1L
  Gene Name: R3H domain and coiled-coil containing 1-like
  Uniprot ID: Q7Z5L2
  ENSP ID: ENSP00000298999
MQQESERCRVRARRPDMALYVPKARRGAVLLKTGDEEESCGSPNSVVKEKQKESSLSQKEVFKDKPEARRLNINPDRKEHNCREEKKSSTKLRMDTCLQKTNRVCSKRGTTESKEVLSQGQQQGAPNAGVITNAPLQRHFKPKKVECLEVETTDVTGHERILLSQACLEISEAQVPSKPFQNVEFCDFSRHEPDGEAFEDKDLEGRIETDTKVLEILYEFPRVFSSVMKPENMIVPIKLSSDSEIVQQSMQTSDGILNPSSGGITTTSVPGSPDGVFDQTCVDFEVESVGGIANSTGFILDQKDTDSIPATMGHISLSESTNDTVSPVMIRECEKNDSTADELHVKHEPPDTAVLAHETHRDSGFKNVGDITNKACMMDTTGMSCSDHVTVDSPYVVAVRIADETSINTRSFSKFVGMSADATPLHVARSGNDTEDFSNPSACSDIYGESISSHFTESTGKLIESLSDCASSLPIKKIAGSNYNTFLDSELSMLNGTKVLSDSAVGIDLGSTGDTTEALHELRTAEEFKTEEQDDSGSIEFGVSFPDRESSSMETSIEPKATETSHTEGITAIEESWESMFNDDGDCLDPRLLQELSGNTKSRESIQEPRSDYYNHEVPDIDLSDCEFPHVIEIYDFPQEFHTEDLLRVFCSYQKKGFDIKWVDDTHALGVFSSPITARDALGIKHTMVKIRPLSQATRAAKAKARAYAEFLQPAKERPETSAALARRLVISALGVRSKQSKTEREAELKKLQEARERKRLEAKQREDIWEGRDQSTV

SEQ ID NO: 70442 - protein, 778 aa, Homo sapiens; identical to SEQ ID NO: 70441
  Payload ID: 13979
  Gene Symbol: R3HCC1L
  Gene Name: R3H domain and coiled-coil containing 1-like
  Uniprot ID: Q7Z5L2
  ENSP ID: ENSP00000314018

SEQ ID NO: 70443 - protein, 778 aa, Homo sapiens; identical to SEQ ID NO: 70441
  Payload ID: 13979
  Gene Symbol: R3HCC1L
  Gene Name: R3H domain and coiled-coil containing 1-like
  Uniprot ID: Q7Z5L2
  ENSP ID: ENSP00000359616

SEQ ID NO: 70444 - protein, 184 aa, Homo sapiens
  Payload ID: 13979
  Gene Symbol: R3HCC1L
  Gene Name: R3H domain and coiled-coil containing 1-like
  Uniprot ID: Q7Z5L2
  ENSP ID: ENSP00000359618
MLSGNTKSRESIQEPRSDYYNHEVPDIDLSDCEFPHVIEIYDFPQEFHTEDLLRVFCSYQKKGFDIKWVDDTHALGVFSSPITARDALGIKHTMVKIRPLSQATRAAKAKARAYAEFLQPAKERPETSAALARRLVISALGVRSKQSKTEREAELKKLQEARERKRLEAKQREDIWEGRDQSTV

SEQ ID NO: 70445 - protein, 184 aa, Homo sapiens; identical to SEQ ID NO: 70444
  Payload ID: 13979
  Gene Symbol: R3HCC1L
  Gene Name: R3H domain and coiled-coil containing 1-like
  Uniprot ID: Q7Z5L2
  ENSP ID: ENSP00000479916

SEQ ID NO: 70446 - protein, 792 aa, Homo sapiens
  Payload ID: 13979
  Gene Symbol: R3HCC1L
  Gene Name: R3H domain and coiled-coil containing 1-like
  ENSP ID: ENSP00000483494
MQQESERCRVRARRPDMALYVPKARRGAVLLKTGDEEESCGSPNSVVKEKQKESSLSQKEVFKDKPEARRLNINPDRKEHNCREEKKSSTKLRMDTCLQKTNRVCSKRGTTESKEVLSQGQQQGAPNAGVITNAPLQRHFKPKKVECLEVETTDVTGHERILLSQACLEISEAQVPSKPFQNVEFCDFSRHEPDGEAFEDKDLEGRIETDTKVLEILYEFPRVFSSVMKPENMIVPIKLSSDSEIVQQSMQTSDGILNPSSGGITTTSVPGSPDGVFDQTCVDFEVESVGGIANSTGFILDQKDTDSIPATMGHISLSESTNDTVSPVMIRECEKNDSTADELHVKHEPPDTAVLAHETHRDSGFKNVGDITNKACMMDTTGMSCSDHVTVDSPYVVAVRIADETSINTRSFSKFVGMSADATPLHVARSGNDTEDFSNPSACSDIYGESISSHFTESTGKLIESLSDCASSLPIKKIAGSNYNTFLDSELSMLNGTKVLSDSAVGIDLGSTGDTTEALHELRTAEEFKTEEQDDSGSIEFGVSFPDRESSSMETSIEPKATETSHTEGITAIEESWESMFNDDGDCLDPRLLQEGILMHIKPENHCSKLSGNTKSRESIQEPRSDYYNHEVPDIDLSDCEFPHVIEIYDFPQEFHTEDLLRVFCSYQKKGFDIKWVDDTHALGVFSSPITARDALGIKHTMVKIRPLSQATRAAKAKARAYAEFLQPAKERPETSAALARRLVISALGVRSKQSKTEREAELKKLQEARERKRLEAKQREDIWEGRDQSTV

SEQ ID NO: 70447 - protein, 1099 aa, Homo sapiens
  Payload ID: 13980
  Gene Symbol: R3HDM1
  Gene Name: R3H domain containing 1
  Uniprot ID: Q15032
  ENSP ID: ENSP00000264160
MRMSDTVTVKDETATMKDLEAEVKDTTRVENLIKSENYGKILVEKNEHCIENNIDLQRPLQSFGQTGKRSKSSSKLKLVRSLAVCEESPPPPAPEISQENQEKIQIQLTQSFEKEEKPSKDEAEKEKASDKLPRKMLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 70448 - protein, 971 aa, Homo sapiens
  Payload ID: 13980
  Gene Symbol: R3HDM1
  Gene Name: R3H domain containing 1
  Uniprot ID: Q15032
  ENSP ID: ENSP00000386457
MRMSDTVTVKDETATMKDLEAEVKDTTRVENLIKSENYGKILVEKNEHCIENNIDLQEKIQIQLTQSFEKEEKPSKDEAEKEKASDKLPRKMLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 70449 - protein, 1044 aa, Homo sapiens
  Payload ID: 13980
  Gene Symbol: R3HDM1
  Gene Name: R3H domain containing 1
  Uniprot ID: Q15032
  ENSP ID: ENSP00000386877
MGLLLPDYRWFTTVDILADNCEKEPWIILFYFCGTPQSQIQRTHQEKIQIQLTQSFEKEEKPSKDEAEKEKASDKLPRKMLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 70450 - protein, 1100 aa, Homo sapiens
  Payload ID: 13980
  Gene Symbol: R3HDM1
  Gene Name: R3H domain containing 1
  Uniprot ID: Q15032
  ENSP ID: ENSP00000387010
MRMSDTVTVKDETATMKDLEAEVKDTTRVENLIKSENYGKILVEKNEHCIENNIDLQRPLQSFGQTGKRSKSSSKLKLVRSLAVCEESPPPPAPEISQENQEKIQIQLTQSFEKEEKPSKDEAEKEKASDKLPRKMLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 70451 - protein, 194 aa, Homo sapiens
  Payload ID: 13980
  Gene Symbol: R3HDM1
  Gene Name: R3H domain containing 1
  ENSP ID: ENSP00000387750
  MOD_RES (1)..(1): Any amino acid
XNKDASGRSTNSHQSSTENELKYSEPRPWSSTDSDSSLRNLKPAVTKASSFSGISVLTRGDSSGSSKSIGRLSKTGQPFINPDGSPVVYNPPMTQQPVRSQVPGPPQPPLPAPPQQPAANHIFSQDNLGSQFSHMSLARQPSADGSDPHAAMFQSTVVLQSPQQSGYIMTAAPPPHPPPPPPPPPPPPPLPPGQ

SEQ ID NO: 70452 - protein, 186 aa, Homo sapiens
  Payload ID: 13980
  Gene Symbol: R3HDM1
  Gene Name: R3H domain containing 1
  ENSP ID: ENSP00000402940
  MOD_RES (1)..(1): Any amino acid
XIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGQPFINPDGSPVVYNPPMTQQPVRSQVPGPPQPPLPAPPQQPAANHIFSQQDNLGSQFSHMSLAR

SEQ ID NO: 70453 - protein, 823 aa, Homo sapiens
  Payload ID: 13980
  Gene Symbol: R3HDM1
  Gene Name: R3H domain containing 1
  ENSP ID: ENSP00000403406
  MOD_RES (1)..(1): Any amino acid
XNRLQDEDASSTQQRRQIFRVNKDASGRSTNSHQSSTENELKYSEPRPWSSTDSDSSLRNLKPAVTKASSFSGISVLTRGDSSGSSKSIGRLSKTGSESSGSVGSSTGSLSHIQQPLPGTALSQSSHGAPVVYPTVSTHSSLSFDGGLNGQVASPSTSFFLLPLEAAGIPPGSILINPQTGQPFINPDGSPVVYNPPMTQQPVRSQVPGPPQPPLPAPPQQPAANHIFSQPVHPLQSSSQPVQYSTAPYPSPFLPVSPTQQYSVQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 70454 - protein, 50 aa, Homo sapiens
  Payload ID: 13980
  Gene Symbol: R3HDM1
  Gene Name: R3H domain containing 1
  ENSP ID: ENSP00000404098
MGLLLPDYRWFTTVDILADNCEKEPWIILFYFCGTPQSQIQRTHQASSSL

SEQ ID NO: 70455 - protein, 284 aa, Homo sapiens
  Payload ID: 13980
  Gene Symbol: R3HDM1
  Gene Name: R3H domain containing 1
  ENSP ID: ENSP00000405668
  MOD_RES (1)..(1): Any amino acid
XDTVTVKDETATMKDLEAEVKDTTRVENLIKSENYGKILVEKNEHCIENNIDLQSSSKLKLVRSLAVCEESPPPPAPEISQENQEKIQIQLTQSFEKEEKPSKDEAEKEKASDKLPRKMLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQMRIRLKDDRRSKSIEEREEEYQRARDRIFSQD

SEQ ID NO: 70456 - protein, 223 aa, Homo sapiens
  Payload ID: 13980
  Gene Symbol: R3HDM1
  Gene Name: R3H domain containing 1
  ENSP ID: ENSP00000413763
  MOD_RES (1)..(1): Any amino acid
XQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQEIPGIHYLASHCSTILLLFCTDTFQTNRVSLAAGMETEEGDKLKKLHPQT

SEQ ID NO: 70457 - protein, 65 aa, Homo sapiens
  Payload ID: 13980
  Gene Symbol: R3HDM1
  Gene Name: R3H domain containing 1
  ENSP ID: ENSP00000416082
MRMSDTVTVKDETATMKDLEAEVKDTTRVENLIKSENYGKILVEKNEHCIENNIDLQGQNDAAEI

SEQ ID NO: 70458 - protein, 971 aa, Homo sapiens; identical to SEQ ID NO: 70448
  Payload ID: 13980
  Gene Symbol: R3HDM1
  Gene Name: R3H domain containing 1
  Uniprot ID: Q15032
  ENSP ID: ENSP00000486837

SEQ ID NO: 70459 - protein, 976 aa, Homo sapiens
  Payload ID: 13981
  Gene Symbol: R3HDM2
  Gene Name: R3H domain containing 2
  Uniprot ID: Q9Y2K5
  ENSP ID: ENSP00000317903
MSNSNTTQETLEIMKESEKKLVEESVNKNKFISKTPSKEEIEKECEDTSLRQETQRRTSNHGHARKRAKSNSKLKLVRSLAVCEESSTPFADGPLETQDIIQLHISCPSDKEEEKSTKDVSEKEDKDKNKEKIPRKMLSRDSSQEYTDSTGIDLHEFLVNTLKKNPRDRMMLLKLEQEILEFINDNNNQFKKFPQMTSYHRMLLHRVAAYFGMDHNVDQTGKAVIINKTSNTRIPEQRFSEHIKDEKNTEFQQRFILKRDDASMDRDDNQTGQNGYLNDIRLSKEAFSSSSHKRRQIFRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 70460 - protein, 976 aa, Homo sapiens; identical to SEQ ID NO: 70459
  Payload ID: 13981
  Gene Symbol: R3HDM2
  Gene Name: R3H domain containing 2
  Uniprot ID: Q9Y2K5
  ENSP ID: ENSP00000351784

SEQ ID NO: 70461 - protein, 1010 aa, Homo sapiens
  Payload ID: 13981
  Gene Symbol: R3HDM2
  Gene Name: R3H domain containing 2
  ENSP ID: ENSP00000385169
MSNSNTTQETLEIMKESEKKLVEESVNKNKFISKTPSKEEIEKECEDTSLRQETQRRTSNHGHARKRAKSNSKLKLVRSLAVCEESSTPFADGPLETQDIIQLHISCPSDKEEEKSTKDVSEKEDKDKNKEKIPRKMLSRDSSQEYTDSTGIDLHEFLVNTLKKNPRDRMMLLKLEQEILEFINDNNNQFKKFPQMTSYHRMLLHRVAAYFGMDHNVDQTGKAVIINKTSNTRIPEQRFSEHIKDEKNTEFQQRFILKRDDASMDRDDNQTGQNGYLNDIRLSKEAFSSSSHKRRQIFRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQPVPALQPSPQPVQFSPSSCPQVLLPVSPPQQYNMADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 70462 - protein, 990 aa, Homo sapiens
  Payload ID: 13981
  Gene Symbol: R3HDM2
  Gene Name: R3H domain containing 2
  ENSP ID: ENSP00000385839
MSNSNTTQETLEIMKESEKKLVEESVNKNKFISKTPSKEEIEKECEDTSLRQETQRRTSNHGHARKRAKSNSKLKLVRSLAVCEESSTPFADGPLETQDIIQLHISCPSDKEEEKSTKDVSEKEDKDKNKEKIPRKMLSRDSSQEYTDSTGIDLHEFLVNTLKKNPRDRMMLLKLEQEILEFINDNNNQFKKFPQMTSYHRMLLHRVAAYFGMDHNVDQTGKAVIINKTSNTRIPEQRFSEHIKDEKNTEFQQRFILKRDDASMDRDDNQIRVPLQDGRRSKSIEEREEEYQRVRERIFARETGQNGYLNDIRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 70463 - protein, 741 aa, Homo sapiens
  Payload ID: 13981
  Gene Symbol: R3HDM2
  Gene Name: R3H domain containing 2
  ENSP ID: ENSP00000394676
KDEKNTEFQQRFILKRDDASMDRDDNQDGRRSKSIEEREEEYQRVRERIFARETGQNGYLNDIRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 70464 - protein, 29 aa, Homo sapiens
  Payload ID: 13981
  Gene Symbol: R3HDM2
  Gene Name: R3H domain containing 2
  ENSP ID: ENSP00000405777
MSNSNTTQETLEIMKESEKKLVEESVNKN

SEQ ID NO: 70465 - protein, 671 aa, Homo sapiens
  Payload ID: 13981
  Gene Symbol: R3HDM2
  Gene Name: R3H domain containing 2
  Uniprot ID: Q9Y2K5
  ENSP ID: ENSP00000408536
MRPPVTKASSFSGISILTRGDSIGSSKGGSAGRISRPGMALGAPEVCNQVTSSQSVRGLLPCTAQQQQQQQQQQLPALPPTPQQQPPLNNHMISQPVPALQPSPQPVQFSPSSCPQVLLPVSPPQQYNMADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 70466 - protein, 280 aa, Homo sapiens
  Payload ID: 13981
  Gene Symbol: R3HDM2
  Gene Name: R3H domain containing 2
  ENSP ID: ENSP00000450411
EEKSTKDVSEKEDKDKNKEKIPRKMLSRDSSQEYTDSTGIDLHEFLVNTLKKNPRDRMMLLKLEQEILEFINDNNNQFKKFPQMTSYHRMLLHRVAAYFGMDHNVDQTGKAVIINKTSNTRIPEQRFSEHIKDEKNTEFQQRFILKRDDASMDRDDNQTGQNGYLNDIRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQ

SEQ ID NO: 70467 - protein, 966 aa, Homo sapiens
  Payload ID: 13981
  Gene Symbol: R3HDM2
  Gene Name: R3H domain containing 2
  ENSP ID: ENSP00000489424
MSNSNTTQETLEIMKESEKKLVEESVNKNKFISKTPSKEEIEKECEDTSLRQETQDYEFLFDKRRTSNHGHARKRAKSNSKLKLVRSLAVCEESSTPFADGPLETQDIIQLHISCPSDKEEEKSTKDVSEKEDKDKNKEKIPRKMLSRDSSQEYTDSTGIDLHEFLVNTLKKNPRDRMMLLKLEQEILEFINDNNNQFKKFPQMTSYHRMLLHRVAAYFGMDHNVDQTGKAVIINKTSNTRIPEQRFSEHIKDEKNTEFQQRFILKRDDASMDRDDNQTGQNGYLNDIRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 70468 - protein, 268 aa, Homo sapiens
  Payload ID: 13982
  Gene Symbol: R3HDM4
  Gene Name: R3H domain containing 4
  Uniprot ID: Q96D70
  ENSP ID: ENSP00000355385
MVALENPECGPEAAEGTPGGRRLLPLPSCLPALASSQVKRLSASRRKQHFINQAVRNSDLVPKAKGRKSLQRLENTQYLLTLLETDGGLPGLEDGDLAPPASPGIFAEACNNATYVEVWNDFMNRSGEEQERVLRYLEDEGRSKARRRGPGRGEDRRREDPAYTPRECFQRISRRLRAVLKRSRIPMETLETWEERLLRFFSVSPQAVYTAMLDNSFERLLLHAVCQYMDLISASADLEGKRQMKVSNRHLDFLPPGLLLSAYLEQHS

SEQ ID NO: 70469 - protein, 247 aa, Homo sapiens
  Payload ID: 13982
  Gene Symbol: R3HDM4
  Gene Name: R3H domain containing 4
  ENSP ID: ENSP00000464744
MVALENPECGPEAAEGTPGGRRLLRKQHFINQAVRNSDLVPKAKGRKSLQRLENTQYLLTLLETDGGLPGLEDGDLAPPASPGIFAEACNNATYVEVWNDFMNRSGEEQERVLRYLEDEGRSKARRRGPGRGEDRRREDPAYTPRECFQRISRRLRAVLKRSRIPMETLETWEERLLRFFSVSPQAVYTAMLDNSFERLLLHAVCQYMDLISASADLEGKRQMKVSNRHLDFLPPGLLLSAYLEQHS

SEQ ID NO: 70470 - protein, 97 aa, Homo sapiens
  Payload ID: 13982
  Gene Symbol: R3HDM4
  Gene Name: R3H domain containing 4
  ENSP ID: ENSP00000466823
MVALENPECGPEAAEGTPGGRRLLPLPSCLPALASSQVKRLSASRRKQHFINQAVRNSDLVPKAKGRKSLQRLENSLERFHEPLRGGAGAGSSLPGG

SEQ ID NO: 70471 - protein, 45 aa, Homo sapiens
  Payload ID: 13982
  Gene Symbol: R3HDM4
  Gene Name: R3H domain containing 4
  ENSP ID: ENSP00000468026
MVALENPECGPEAAEGTPGGRRLLLALLPRLECSGAIMPTSTSWT

SEQ ID NO: 70472 - protein, 45 aa, Homo sapiens; identical to SEQ ID NO: 70471
  Payload ID: 13982
  Gene Symbol: R3HDM4
  Gene Name: R3H domain containing 4
  ENSP ID: ENSP00000486092

SEQ ID NO: 70473 - protein, 253 aa, Homo sapiens
  Payload ID: 13983
  Gene Symbol: R3HDML
  Gene Name: R3H domain containing-like
  Uniprot ID: Q9H3Y0
  ENSP ID: ENSP00000217043
MPLLPSTVGLAGLLFWAGQAVNALIMPNATPAPAQPESTAMRLLSGLEVPRYRRKRHISVRDMNALLDYHNHIRASVYPPAANMEYMVWDKRLARAAEAWATQCIWAHGPSQLMRYVGQNLSIHSGQYRSVVDLMKSWSEEKWHYLFPAPRDCNPHCPWRCDGPTCSHYTQMVWASSNRLGCAIHTCSSISVWGNTWHRAAYLVCNYAIKGNWIGESPYKMGKPCSSCPPSYQGSCNSNMCFKGLKSNKFTWF

SEQ ID NO: 70474 - protein, 185 aa, Homo sapiens
  Payload ID: 13984
  Gene Symbol: RABAC1
  Gene Name: Rab acceptor 1 (prenylated)
  Uniprot ID: Q9UI14
  ENSP ID: ENSP00000222008
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLGATLVVIGSHAAFHQIEAVDGEELQMEPV

SEQ ID NO: 70475 - protein, 109 aa, Homo sapiens
  Payload ID: 13984
  Gene Symbol: RABAC1
  Gene Name: Rab acceptor 1 (prenylated)
  ENSP ID: ENSP00000469161
GREWLERRRATIRPWSTFVDQQRFSRPRNLGELCQRLVRNVEYYQSNYVFVFLGLILYCVPRGEPSASVCSGWRHLLPLLLAGWCGLGRLLGAGSHPGGHRLPRCLPPD

SEQ ID NO: 70476 - protein, 91 aa, Homo sapiens
  Payload ID: 13984
  Gene Symbol: RABAC1
  Gene Name: Rab acceptor 1 (prenylated)
  ENSP ID: ENSP00000469392
MLLVALAVFFGACYILYLRTLESKLVLFGREVSPAHQYALAGGISFPFFWLAGAGSAVFWVLGATLVVIGSHAAFHQIEAVDGEELQMEPV

SEQ ID NO: 70477 - protein, 149 aa, Homo sapiens
  Payload ID: 13984
  Gene Symbol: RABAC1
  Gene Name: Rab acceptor 1 (prenylated)
  ENSP ID: ENSP00000471877
  MOD_RES (1)..(1): Any amino acid
XDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLD

SEQ ID NO: 70478 - protein, 151 aa, Homo sapiens
  Payload ID: 13984
  Gene Symbol: RABAC1
  Gene Name: Rab acceptor 1 (prenylated)
  ENSP ID: ENSP00000473152
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGATLVVIGSHAAFHQIEAVDGEELQMEPV

SEQ ID NO: 70479 - protein, 567 aa, Homo sapiens
  Payload ID: 13985
  Gene Symbol: RABGGTA
  Gene Name: Rab geranylgeranyltransferase, alpha subunit
  Uniprot ID: Q92696
  ENSP ID: ENSP00000216840
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 70480 - protein, 567 aa, Homo sapiens; identical to SEQ ID NO: 70479
  Payload ID: 13985
  Gene Symbol: RABGGTA
  Gene Name: Rab geranylgeranyltransferase, alpha subunit
  Uniprot ID: Q92696
  ENSP ID: ENSP00000382341

SEQ ID NO: 70481 - protein, 73 aa, Homo sapiens
  Payload ID: 13985
  Gene Symbol: RABGGTA
  Gene Name: Rab geranylgeranyltransferase, alpha subunit
  ENSP ID: ENSP00000452890
MHGRLKVKTSEEQAEAKRLEREQKLKLYQSATQAVFQKRQAGELDESVLELTSQILGANPDFATLWNCRREVS

SEQ ID NO: 70482 - protein, 136 aa, Homo sapiens
  Payload ID: 13985
  Gene Symbol: RABGGTA
  Gene Name: Rab geranylgeranyltransferase, alpha subunit
  ENSP ID: ENSP00000453001
QSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEDPPPRTGAAGQ

SEQ ID NO: 70483 - protein, 176 aa, Homo sapiens
  Payload ID: 13985
  Gene Symbol: RABGGTA
  Gene Name: Rab geranylgeranyltransferase, alpha subunit
  ENSP ID: ENSP00000453201
MRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 70484 - protein, 424 aa, Homo sapiens
  Payload ID: 13985
  Gene Symbol: RABGGTA
  Gene Name: Rab geranylgeranyltransferase, alpha subunit
  ENSP ID: ENSP00000453207
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKASRGPHAGNVSG

SEQ ID NO: 70485 - protein, 175 aa, Homo sapiens
  Payload ID: 13985
  Gene Symbol: RABGGTA
  Gene Name: Rab geranylgeranyltransferase, alpha subunit
  ENSP ID: ENSP00000453596
  MOD_RES (1)..(1): Any amino acid
XSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNPACSAPASCLLPQAGPPQPAG

SEQ ID NO: 70486 - protein, 424 aa, Homo sapiens; identical to SEQ ID NO: 70484
  Payload ID: 13985
  Gene Symbol: RABGGTA
  Gene Name: Rab geranylgeranyltransferase, alpha subunit
  ENSP ID: ENSP00000453890

SEQ ID NO: 70487 - protein, 331 aa, Homo sapiens
  Payload ID: 13986
  Gene Symbol: RABGGTB
  Gene Name: Rab geranylgeranyltransferase, beta subunit
  Uniprot ID: P53611
  ENSP ID: ENSP00000317473
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGEIDTRFSFCAVATLALLGKLDAINVEKAIEFVLSCMNFDGGFGCRPGSESHAGQIYCCTGFLAITSQLHQVNSDLLGWWLCERQLPSGGLNGRPEKLPDVCYSWWVLASLKIIGRLHWIDREKLRNFILACQDEETGGFADRPGDMVDPFHTLFGIAGLSLLGEEQIKPVNPVFCMPEEVLQRVNVQPELVS

SEQ ID NO: 70488 - protein, 152 aa, Homo sapiens
  Payload ID: 13986
  Gene Symbol: RABGGTB
  Gene Name: Rab geranylgeranyltransferase, beta subunit
  ENSP ID: ENSP00000359862
MGTPQKDVIIKSDAPDTLLLEKHADYIASYGSKKDDYEYCMSEYLRMSGIYWGLTVMDLMGQLHRMNREEILAFIKSCQHECGGISASIGHDPHLLYTLSAVQILTLYDSINVIDVNKVVEYVKGLQKEDGSFAGDIWGNVRFSPFYPKYQY

SEQ ID NO: 70489 - protein, 1069 aa, Homo sapiens
  Payload ID: 13987
  Gene Symbol: RABGAP1
  Gene Name: RAB GTPase activating protein 1
  Uniprot ID: Q9Y3P9
  ENSP ID: ENSP00000362751
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLESESERERRKTTASPSVRLPQSGSQSSVIPSPPEDDEEEDNDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRLEEESAQLKEMCRRELDKAESEIKKNSSIIGDYKQICSQLSERLEKQQTANKVEIEKIRQKVDDCERCREFFNKEGRVKGISSTKEVLDEDTDEEKETLKNQLREMELELAQTKLQLVEAECKIQDLEHHLGLALNEVQAAKKTWFNRTLSSIKTATGVQGKETC

SEQ ID NO: 70490 - protein, 112 aa, Homo sapiens
  Payload ID: 13987
  Gene Symbol: RABGAP1
  Gene Name: RAB GTPase activating protein 1
  ENSP ID: ENSP00000384119
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLV

SEQ ID NO: 70491 - protein, 599 aa, Homo sapiens
  Payload ID: 13987
  Gene Symbol: RABGAP1
  Gene Name: RAB GTPase activating protein 1
  Uniprot ID: Q9Y3P9
  ENSP ID: ENSP00000414386
MDPPMDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLESESERERRKTTASPSVRLPQSGSQSSVIPSPPEDDEEEDNDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKVFHVKKKKDSILSGGSTLKLHKKQLQSVICI

SEQ ID NO: 70492 - protein, 66 aa, Homo sapiens
  Payload ID: 13987
  Gene Symbol: RABGAP1
  Gene Name: RAB GTPase activating protein 1
  ENSP ID: ENSP00000416327
MDDKASVGKISVSSDSVSTLNSEDFVLVSRQGDETPSTNNGSDDEKTGLKILKLQVLSHQWPMRTA

SEQ ID NO: 70493 - protein, 349 aa, Homo sapiens; identical to SEQ ID NO: 33535
  Payload ID: 13987
  Gene Symbol: RABGAP1
  Gene Name: RAB GTPase activating protein 1
  ENSP ID: ENSP00000482287

SEQ ID NO: 70494 - protein, 815 aa, Homo sapiens
  Payload ID: 13988
  Gene Symbol: RABGAP1L
  Gene Name: RAB GTPase activating protein 1-like
  Uniprot ID: Q5R372
  ENSP ID: ENSP00000251507
MEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKFVYL

SEQ ID NO: 70495 - protein, 378 aa, Homo sapiens
  Payload ID: 13988
  Gene Symbol: RABGAP1L
  Gene Name: RAB GTPase activating protein 1-like
  Uniprot ID: Q5R372
  ENSP ID: ENSP00000281844
MKEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 70496 - protein, 358 aa, Homo sapiens
  Payload ID: 13988
  Gene Symbol: RABGAP1L
  Gene Name: RAB GTPase activating protein 1-like
  Uniprot ID: Q5R372
  ENSP ID: ENSP00000318603
MYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 70497 - protein, 605 aa, Homo sapiens
  Payload ID: 13988
  Gene Symbol: RABGAP1L
  Gene Name: RAB GTPase activating protein 1-like
  Uniprot ID: Q5R372
  ENSP ID: ENSP00000350027
MEVRASLQKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKQQMKFSLTPRQTIHLVKYEGSMKVSMTPCNQLQFDIRLDVLITYTFCFSSFPEPELYKYVLKHQLIKRLNAC

SEQ ID NO: 70498 - protein, 377 aa, Homo sapiens
  Payload ID: 13988
  Gene Symbol: RABGAP1L
  Gene Name: RAB GTPase activating protein 1-like
  Uniprot ID: Q5R372
  ENSP ID: ENSP00000356660
MEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 70499 - protein, 253 aa, Homo sapiens
  Payload ID: 13988
  Gene Symbol: RABGAP1L
  Gene Name: RAB GTPase activating protein 1-like
  Uniprot ID: B7ZAP0
  ENSP ID: ENSP00000356661
MIENSSWSMTFEERENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 70500 - protein, 308 aa, Homo sapiens
  Payload ID: 13988
  Gene Symbol: RABGAP1L
  Gene Name: RAB GTPase activating protein 1-like
  ENSP ID: ENSP00000375916
MMEEISIMVAYDAHVFSQLHDEDFLTSLVAISKPRSMVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 70501 - protein, 582 aa, Homo sapiens
  Payload ID: 13988
  Gene Symbol: RABGAP1L
  Gene Name: RAB GTPase activating protein 1-like
  ENSP ID: ENSP00000403136
MEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFRLLVIPIPFEYFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITK

SEQ ID NO: 70502 - protein, 370 aa, Homo sapiens
  Payload ID: 13988
  Gene Symbol: RABGAP1L
  Gene Name: RAB GTPase activating protein 1-like
  Uniprot ID: Q5R372
  ENSP ID: ENSP00000420660
MEEGVPCPAPAAKLTPPVKKSQDMHDERSKLVNEYACRVLELLGMGHRLFVPRLLATSKEDLLQADFEGALKFFRVQLPKRYRAEENARRLMEQACNIKVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 70503 - protein, 72 aa, Homo sapiens
  Payload ID: 13988
  Gene Symbol: RABGAP1L
  Gene Name: RAB GTPase activating protein 1-like
  Uniprot ID: Q5R372
  ENSP ID: ENSP00000432490
MMEEISIMVAYDAHVFSQLHDEDFLTSLVAISKPRSMVPTKKLKKYEKEYQTMRESQLQQEDPMDRYKFVYL

SEQ ID NO: 70504 - protein, 97 aa, Homo sapiens
  Payload ID: 13988
  Gene Symbol: RABGAP1L
  Gene Name: RAB GTPase activating protein 1-like
  ENSP ID: ENSP00000432734
MYASQWFLTLFTAKFPLCMVFHIIDLLLCEGLNIIFHVALALLKTSKEDLLQADFEGALKFFRVQLPKRYRAEENARRLMEQACNIKVGVYTGTELQ

SEQ ID NO: 70505 - protein, 72 aa, Homo sapiens; identical to SEQ ID NO: 70503
  Payload ID: 13988
  Gene Symbol: RABGAP1L
  Gene Name: RAB GTPase activating protein 1-like
  Uniprot ID: Q5R372
  ENSP ID: ENSP00000434600

SEQ ID NO: 70506 - protein, 190 aa, Homo sapiens
  Payload ID: 13988
  Gene Symbol: RABGAP1L
  Gene Name: RAB GTPase activating protein 1-like
  ENSP ID: ENSP00000435911
MMEEISIMVAYDAHVFSQLHDEDFLTSLVAISKPRSMVPTKKLKKYEKEYQTMRESQLQQEDPMDRYKRENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEV

SEQ ID NO: 70507 - protein, 111 aa, Homo sapiens
  Payload ID: 13988
  Gene Symbol: RABGAP1L
  Gene Name: RAB GTPase activating protein 1-like
  ENSP ID: ENSP00000489163
MYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQE

SEQ ID NO: 70508 - protein, 97 aa, Homo sapiens; identical to SEQ ID NO: 70504
  Payload ID: 13988
  Gene Symbol: RABGAP1L
  Gene Name: RAB GTPase activating protein 1-like
  ENSP ID: ENSP00000489178

SEQ ID NO: 70509 - protein, 87 aa, Homo sapiens
  Payload ID: 13988
  Gene Symbol: RABGAP1L
  Gene Name: RAB GTPase activating protein 1-like
  ENSP ID: ENSP00000489188
SSWSMTFEERENRRLQEASMRLEQENDDLAHELVTSKIALRNDLDQAEDKADVLNKELLLTKQRLVETEEEKRKQEEETAQENHMCN

SEQ ID NO: 70510 - protein, 166 aa, Homo sapiens
  Payload ID: 13988
  Gene Symbol: RABGAP1L
  Gene Name: RAB GTPase activating protein 1-like
  ENSP ID: ENSP00000489213
SAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCESGISALQFTGMVTF

SEQ ID NO: 70511 - protein, 245 aa, Homo sapiens
  Payload ID: 13988
  Gene Symbol: RABGAP1L
  Gene Name: RAB GTPase activating protein 1-like
  ENSP ID: ENSP00000489232
MEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEARWGSRW

SEQ ID NO: 70512 - protein, 252 aa, Homo sapiens
  Payload ID: 13988
  Gene Symbol: RABGAP1L
  Gene Name: RAB GTPase activating protein 1-like
  ENSP ID: ENSP00000489605
MGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKVCWSLLEVHSRPCLPGYHQWKLQNSKYCRMANVAA

SEQ ID NO: 70513 - protein, 491 aa, Homo sapiens
  Payload ID: 13989
  Gene Symbol: RABGEF1
  Gene Name: RAB guanine nucleotide exchange factor (GEF) 1
  Uniprot ID: Q9UJ41
  ENSP ID: ENSP00000284957
MSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 70514 - protein, 505 aa, Homo sapiens
  Payload ID: 13989
  Gene Symbol: RABGEF1
  Gene Name: RAB guanine nucleotide exchange factor (GEF) 1
  Uniprot ID: Q9UJ41
  ENSP ID: ENSP00000370208
MMASSYHEVVSRKKMSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 70515 - protein, 299 aa, Homo sapiens
  Payload ID: 13989
  Gene Symbol: RABGEF1
  Gene Name: RAB guanine nucleotide exchange factor (GEF) 1
  ENSP ID: ENSP00000390480
MQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 70516 - protein, 504 aa, Homo sapiens
  Payload ID: 13989
  Gene Symbol: RABGEF1
  Gene Name: RAB guanine nucleotide exchange factor (GEF) 1
  ENSP ID: ENSP00000403429
MASSYHEVVSRKKMSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 70517 - protein, 45 aa, Homo sapiens
  Payload ID: 13989
  Gene Symbol: RABGEF1
  Gene Name: RAB guanine nucleotide exchange factor (GEF) 1
  ENSP ID: ENSP00000415503
MSLKSERRGIHVDQSDLLCKKGCGYYGNPAWQGFCSKCWREEYHK

SEQ ID NO: 70518 - protein, 491 aa, Homo sapiens; identical to SEQ ID NO: 70513
  Payload ID: 13989
  Gene Symbol: RABGEF1
  Gene Name: RAB guanine nucleotide exchange factor (GEF) 1
  Uniprot ID: Q9UJ41
  ENSP ID: ENSP00000415815

SEQ ID NO: 70519 - protein, 407 aa, Homo sapiens
  Payload ID: 13989
  Gene Symbol: RABGEF1
  Gene Name: RAB guanine nucleotide exchange factor (GEF) 1
  ENSP ID: ENSP00000421124
MSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 70520 - protein, 119 aa, Homo sapiens
  Payload ID: 13989
  Gene Symbol: RABGEF1
  Gene Name: RAB guanine nucleotide exchange factor (GEF) 1
  ENSP ID: ENSP00000476796
MSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKGSKH

SEQ ID NO: 70521 - protein, 123 aa, Homo sapiens
  Payload ID: 13990
  Gene Symbol: RABIF
  Gene Name: RAB interacting factor
  Uniprot ID: P47224
  ENSP ID: ENSP00000356231
MEPAEQPSELVSAEGRNRKAVLCQRCGSRVLQPGTALFSRRQLFLPSMRKKPALSDGSNPDGDLLQEHWLVEDMFIFENVGFTKDVGNIKFLVCADCEIGPIGWHCLDDKNSFYVALERVSHE

SEQ ID NO: 70522 - protein, 401 aa, Homo sapiens
  Payload ID: 13991
  Gene Symbol: RILP
  Gene Name: Rab interacting lysosomal protein
  Uniprot ID: Q96NA2
  ENSP ID: ENSP00000301336
MEPRRAAPGVPGWGSREAAGSASAAELVYHLAGALGTELQDLARRFGPEAAAGLVPLVVRALELLEQAAVGPAPDSLQVSAQPAEQELRRLREENERLRRELRAGPQEERALLRQLKEVTDRQRDELRAHNRDLRQRGQETEALQEQLQRLLLVNAELRHKLAAMQTQLRAAQDRERERQQPGEAATPQAKERARGQAGRPGHQHGQEPEWATAGAGAPGNPEDPAEAAQQLGRPSEAGQCRFSREEFEQILQERNELKAKVFLLKEELAYFQRELLTDHRVPGLLLEAMKVAVRKQRKKIKAKMLGTPEEAESSEDEAGPWILLSDDKGDHPPPPESKIQSFFGLWYRGKAESSEDETSSPAPSKLGGEEEAQPQSPAPDPPCSALHEHLCLGASAAPEA

SEQ ID NO: 70523 - protein, 226 aa, Homo sapiens
  Payload ID: 13991
  Gene Symbol: RILP
  Gene Name: Rab interacting lysosomal protein
  ENSP ID: ENSP00000459101
LQRLLLVNAELRHKLAAMQTQLRAAQDRERERQQPGEAATPQAKERARGQAGRPGHQHGQEPEWATAGAGAPGNPEDPAEAAQQLGRPSEAGQCRFSREEFEQILQERNELKAKVFLLKEELAYFQRELLTDHRVPGLLLEAMKVAVRKQRKKIKAKMLGTPEEAESSFGLWYRGKAESSEDETSSPAPSKLGGEEEAQPQSPAPDPPCSALHEHLCLGASAAPEA

SEQ ID NO: 70524 - protein, 401 aa, Homo sapiens; identical to SEQ ID NO: 70522
  Payload ID: 13991
  Gene Symbol: RILP
  Gene Name: Rab interacting lysosomal protein
  Uniprot ID: Q96NA2
  ENSP ID: ENSP00000481849

SEQ ID NO: 70525 - protein, 226 aa, Homo sapiens; identical to SEQ ID NO: 70523
  Payload ID: 13991
  Gene Symbol: RILP
  Gene Name: Rab interacting lysosomal protein
  ENSP ID: ENSP00000488063

SEQ ID NO: 70526 - protein, 283 aa, Homo sapiens
  Payload ID: 13992
  Gene Symbol: RILPL1
  Gene Name: Rab interacting lysosomal protein-like 1
  ENSP ID: ENSP00000345874
MSMSERERQVMKKLKEVVDKQRDEIRAKDRELGLKNEDVEALQQQQTRLMKINHDLRHRVTVVEAQGKALIEQKVELEADLQTKEQEMGSLRAELGKLRERLQGEHSQNGEEEPETEPVGEESISDAEKVAMDLKDPNRPRFTLQELRDVLHERNELKSKVFLLQEELAYYKRFPHETTSNMRPEVLFILSMAKFPALRMELGTHEEMEEENRIPQPPPIAHPRTSPQPESGIKRLFSFFSRDKKRLANTQRNVHIQESFGQWANTHRDDGYTEQGQEALQHL

SEQ ID NO: 70527 - protein, 403 aa, Homo sapiens
  Payload ID: 13992
  Gene Symbol: RILPL1
  Gene Name: Rab interacting lysosomal protein-like 1
  Uniprot ID: Q5EBL4
  ENSP ID: ENSP00000366070
MEEERGSALAAESALEKNVAELTVMDVYDIASLVGHEFERVIDQHGCEAIARLMPKVVRVLEILEVLVSRHHVAPELDELRLELDRLRLERMDRIEKERKHQKELELVEDVWRGEAQDLLSQIAQLQEENKQLMTNLSHKDVNFSEEEFQKHEGMSERERQVMKKLKEVVDKQRDEIRAKDRELGLKNEDVEALQQQQTRLMKINHDLRHRVTVVEAQGKALIEQKVELEADLQTKEQEMGSLRAELGKLRERLQGEHSQNGEEEPETEPVGEESISDAEKVAMDLKDPNRPRFTLQELRDVLHERNELKSKVFLLQEELAYYKSEEMEEENRIPQPPPIAHPRTSPQPESGIKRLFSFFSRDKKRLANTQRNVHIQESFGQWANTHRDDGYTEQGQEALQHL

SEQ ID NO: 70528 - protein, 76 aa, Homo sapiens [sequence omitted]

SEQ ID NO: 70529 - protein, 211 aa, Homo sapiens
  Payload ID: 13993
  Gene Symbol: RILPL2
  Gene Name: Rab interacting lysosomal protein-like 2
  Uniprot ID: Q969X0
  ENSP ID: ENSP00000280571
MEEPPVREEEEEEGEEDEERDEVGPEGALGKSPFQLTAEDVYDISYLLGRELMALGSDPRVTQLQFKVVRVLEMLEALVNEGSLALEELKMERDHLRKEVEGLRRQSPPASGEVNLGPNKMVVDLTDPNRPRFTLQELRDVLQERNKLKSQLLVVQEELQCYKSGLIPPREGPGGRREKDAVVTSAKNAGRNKEEKTIIKKLFFFRSGKQT

SEQ ID NO: 70530 - protein, 165 aa, Homo sapiens
  Payload ID: 13994
  Gene Symbol: RABL2A
  Gene Name: RAB, member of RAS oncogene family-like 2A
  ENSP ID: ENSP00000365622
MAEDKTKPSELDQGKYDADDNVKIICLGDSAVGKSKLMERFLMDGFQPQQLSTYALTLYKHTATVDGKTILVADINVTQKSFNFAKKFSLPLYFVSAADGTNVVKLFNDAIRLAVSYKQNSQDFMDEIFQELENFSLEQEEEDVPDQEQSSSIETPSEEVASPHS

SEQ ID NO: 70531 - protein, 229 aa, Homo sapiens
  Payload ID: 13994
  Gene Symbol: RABL2A
  Gene Name: RAB, member of RAS oncogene family-like 2A
  Uniprot ID: Q9UBK7
  ENSP ID: ENSP00000376870
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLSTWYTELREFRPEIPCIVVANKIDADINVTQKSFNFAKKFSLPLYFVSAADGTNVVKLFNDAIRLAVSYKQNSQDFMDEIFQELENFSLEQEEEDVPDQEQSSSIETPSEEVASPHS

SEQ ID NO: 70532 - protein, 228 aa, Homo sapiens
  Payload ID: 13994
  Gene Symbol: RABL2A
  Gene Name: RAB, member of RAS oncogene family-like 2A
  Uniprot ID: Q9UBK7
  ENSP ID: ENSP00000376871
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLSTWYTELREFRPEIPCIVVANKIDDINVTQKSFNFAKKFSLPLYFVSAADGTNVVKLFNDAIRLAVSYKQNSQDFMDEIFQELENFSLEQEEEDVPDQEQSSSIETPSEEVASPHS

SEQ ID NO: 70533 - protein, 228 aa, Homo sapiens; identical to SEQ ID NO: 70532
  Payload ID: 13994
  Gene Symbol: RABL2A
  Gene Name: RAB, member of RAS oncogene family-like 2A
  Uniprot ID: Q9UBK7
  ENSP ID: ENSP00000376872

SEQ ID NO: 70534 - protein, 165 aa, Homo sapiens; identical to SEQ ID NO: 70530
  Payload ID: 13994
  Gene Symbol: RABL2A
  Gene Name: RAB, member of RAS oncogene family-like 2A
  ENSP ID: ENSP00000386460

SEQ ID NO: 70535 - protein, 238 aa, Homo sapiens
  Payload ID: 13994
  Gene Symbol: RABL2A
  Gene Name: RAB, member of RAS oncogene family-like 2A
  Uniprot ID: Q9UBK7
  ENSP ID: ENSP00000387229
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLSTWYTELREFRPEIPCIVVANKIDDINVTQKSFNFAKKFSLPLYFVSAADGTNVVKVWLTAEVASKLFNDAIRLAVSYKQNSQDFMDEIFQELENFSLEQEEEDVPDQEQSSSIETPSEEVASPHS

SEQ ID NO: 70536 - protein, 114 aa, Homo sapiens
  Payload ID: 13994
  Gene Symbol: RABL2A
  Gene Name: RAB, member of RAS oncogene family-like 2A
  ENSP ID: ENSP00000388944
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMVFDIQRKVTYRNLST

SEQ ID NO: 70537 - protein, 101 aa, Homo sapiens
  Payload ID: 13994
  Gene Symbol: RABL2A
  Gene Name: RAB, member of RAS oncogene family-like 2A
  ENSP ID: ENSP00000399360
MAEDKTKPSELDQGKYDADDNVKIICLGDSAVGKSKLMERFLMDGFQPQQLSTYALTLYKHTATVDGKTILVDFWDTAGQERFQSMHASYYHKAHACIMQT

SEQ ID NO: 70538 - protein, 54 aa, Homo sapiens
  Payload ID: 13994
  Gene Symbol: RABL2A
  Gene Name: RAB, member of RAS oncogene family-like 2A
  ENSP ID: ENSP00000415510
MAEDKTKPSELDQGKYDADDNVKIICLGDSAVGKSKLMERFLMDGFHSSCPRTP

SEQ ID NO: 70539 - protein, 229 aa, Homo sapiens
  Payload ID: 13995
  Gene Symbol: RABL2B
  Gene Name: RAB, member of RAS oncogene family-like 2B
  Uniprot ID: Q9UNT1
  ENSP ID: ENSP00000346940
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDADINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 70540 - protein, 99 aa, Homo sapiens
  Payload ID: 13995
  Gene Symbol: RABL2B
  Gene Name: RAB, member of RAS oncogene family-like 2B
  ENSP ID: ENSP00000378955
MAEDKTKPSELDQGKYDADDNVKIICLGDSAVGKSKLMERFLMDGFQPQQLSTYALTLYKHTATVDGRTILVDFWDTAGQERFQSMHASYYHKAHACIM

SEQ ID NO: 70541 - protein, 165 aa, Homo sapiens
  Payload ID: 13995
  Gene Symbol: RABL2B
  Gene Name: RAB, member of RAS oncogene family-like 2B
  ENSP ID: ENSP00000378956
MAEDKTKPSELDQGKYDADDNVKIICLGDSAVGKSKLMERFLMDGFQPQQLSTYALTLYKHTATVDGRTILVADINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 70542 - protein, 238 aa, Homo sapiens
  Payload ID: 13995
  Gene Symbol: RABL2B
  Gene Name: RAB, member of RAS oncogene family-like 2B
  Uniprot ID: Q9UNT1
  ENSP ID: ENSP00000378958
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDDINVTQKSFNFAKKFSLPLYFVSAADGTNVVKVWLTAEVASKLFNDAIRLAVSYKQNSQDFMDEIFQELENFSLEQEEEDVPDQEQSSSIETPSEEAASPHS

SEQ ID NO: 70543 - protein, 229 aa, Homo sapiens; identical to SEQ ID NO: 70539
  Payload ID: 13995
  Gene Symbol: RABL2B
  Gene Name: RAB, member of RAS oncogene family-like 2B
  Uniprot ID: Q9UNT1
  ENSP ID: ENSP00000378960

SEQ ID NO: 70544 - protein, 228 aa, Homo sapiens
  Payload ID: 13995
  Gene Symbol: RABL2B
  Gene Name: RAB, member of RAS oncogene family-like 2B
  Uniprot ID: Q9UNT1
  ENSP ID: ENSP00000378962
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDDINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 70545 - protein, 101 aa, Homo sapiens
  Payload ID: 13995
  Gene Symbol: RABL2B
  Gene Name: RAB, member of RAS oncogene family-like 2B
  ENSP ID: ENSP00000398282
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMQT

SEQ ID NO: 70546 - protein, 101 aa, Homo sapiens; identical to SEQ ID NO: 70545
  Payload ID: 13995
  Gene Symbol: RABL2B
  Gene Name: RAB, member of RAS oncogene family-like 2B
  ENSP ID: ENSP00000399988

SEQ ID NO: 70547 - protein, 228 aa, Homo sapiens; identical to SEQ ID NO: 70544
  Payload ID: 13995
  Gene Symbol: RABL2B
  Gene Name: RAB, member of RAS oncogene family-like 2B
  Uniprot ID: Q9UNT1
  ENSP ID: ENSP00000401906

SEQ ID NO: 70548 - protein, 20 aa, Homo sapiens
  Payload ID: 13995
  Gene Symbol: RABL2B
  Gene Name: RAB, member of RAS oncogene family-like 2B
  ENSP ID: ENSP00000415180
MAEDKTKPSELDQGKYDADD

SEQ ID NO: 70549 - protein, 39 aa, Homo sapiens
  Payload ID: 13995
  Gene Symbol: RABL2B
  Gene Name: RAB, member of RAS oncogene family-like 2B
  ENSP ID: ENSP00000419811
MAEDKTKPSELDQGKYDADDNVKIICLGDSAVGKSKHNN

SEQ ID NO: 70550 - protein, 236 aa, Homo sapiens
  Payload ID: 13996
  Gene Symbol: RABL3
  Gene Name: RAB, member of RAS oncogene family-like 3
  Uniprot ID: Q5HYI8
  ENSP ID: ENSP00000273375
MASLDRVKVLVLGDSGVGKSSLVHLLCQNQVLGNPSWTVGCSVDVRVHDYKEGTPEEKTYYIELWDVGGSVGSASSVKSTRAVFYNSVNGIIFVHDLTNKKSSQNLRRWSLEALNRDLVPTGVLVTNGDYDQEQFADNQIPLLVIGTKLDQIHETKRHEVLTRTAFLAEDFNPEEINLDCTNPRYLAAGSSNAVKLSRFFDKVIEKRYFLREGNQIPGFPDRKRFGAGTLKSLHYD

SEQ ID NO: 70551 - protein, 53 aa, Homo sapiens
  Payload ID: 13996
  Gene Symbol: RABL3
  Gene Name: RAB, member of RAS oncogene family-like 3
  ENSP ID: ENSP00000417266
MASLDRVKVLVLGDSGVGKSSLVHLLCQNQVLGNPSWTVGCSVDVRVLFSYTT

SEQ ID NO: 70552 - protein, 53 aa, Homo sapiens
  Payload ID: 13996
  Gene Symbol: RABL3
  Gene Name: RAB, member of RAS oncogene family-like 3
  ENSP ID: ENSP00000418854
  MOD_RES (1)..(1): Any amino acid
XASLDRVKVLVLGDSGVGKSSLVHLLCQNQVLGNPSWTVGCSVDVRVLFSYTT

SEQ ID NO: 70553 - protein, 129 aa, Homo sapiens
  Payload ID: 13996
  Gene Symbol: RABL3
  Gene Name: RAB, member of RAS oncogene family-like 3
  ENSP ID: ENSP00000419310
MASLDRVKVLVLGDSGVGKSSLVHLLCQNQVLGNPSWTVGCSVDVRVHDYKEGTPEEKTYYIELWDVGGSVGSASSVKSTRAVFYNSVNGIIFVHDLTNKKSSQNLRRWSLEALNRDLVPTGVLVTNGD

SEQ ID NO: 70554 - protein, 212 aa, Homo sapiens
  Payload ID: 13996
  Gene Symbol: RABL3
  Gene Name: RAB, member of RAS oncogene family-like 3
  ENSP ID: ENSP00000419986
MASLDRVKVLVLGDSGVGKSSLVHLLCQNQVLGNPSWTVGCSVDVRVHDYKEGTPEEKTYYIELWDVGGSVGSASSVKSTRAVFYNSVNGIIFVHDLTNKKSSQNLRRWSLEALNRDLVPTGVLVTNGDYDQEQFADNQIPLLVIGTKLDQIHETKRHEVLTRTAFLAEDFNPEEINLVIEKRYFLREGNQIPGFPDRKRFGAGTLKSLHYD

SEQ ID NO: 70555 - protein, 135 aa, Homo sapiens
  Payload ID: 13996
  Gene Symbol: RABL3
  Gene Name: RAB, member of RAS oncogene family-like 3
  ENSP ID: ENSP00000420573
MASLDRVKVLVLGDSGVGKSSLVHLLCQNQVLGNPSWTVGCSVDVRVHDYKEGTPEEKTYYIELWDVGGSVGSASSVKSTRAVFYNSVNGIIFVHDLTNKKSSQNLRRWSLEALNRDLVPTGVLVTNGTAQIHGT

SEQ ID NO: 70556 - protein, 729 aa, Homo sapiens
  Payload ID: 13997
  Gene Symbol: RABL6
  Gene Name: RAB, member RAS oncogene family-like 6
  Uniprot ID: Q3YEC7
  ENSP ID: ENSP00000311134
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGRHPGGGDYEEL

SEQ ID NO: 70557 - protein, 520 aa, Homo sapiens
  Payload ID: 13997
  Gene Symbol: RABL6
  Gene Name: RAB, member RAS oncogene family-like 6
  Uniprot ID: Q3YEC7
  ENSP ID: ENSP00000350056
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRPPPWGWRLRGALGRRGQWPPWGGGRACHCLGRHLPLYHRLCRCPVAAVCASELEEAGHWWSPGWALQVLGLQAQCEPALQEGRGQLASARLGGHPGPLGAEPPVFLRDVTEAQEGPVRVCLQRLGRGRLAVGCALPRHLLALRAHLGPQHAYGSASGREP

SEQ ID NO: 70558 - protein, 716 aa, Homo sapiens
  Payload ID: 13997
  Gene Symbol: RABL6
  Gene Name: RAB, member RAS oncogene family-like 6
  Uniprot ID: Q3YEC7
  ENSP ID: ENSP00000360727
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDSRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGA

SEQ ID NO: 70559 - protein, 314 aa, Homo sapiens
  Payload ID: 13997
  Gene Symbol: RABL6
  Gene Name: RAB, member RAS oncogene family-like 6
  Uniprot ID: Q3YEC7
  ENSP ID: ENSP00000360736
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQKDVRLAQERGCAVVLVSEEVRMPAGWDCCWGRLGWKEGGSQTCPVPALLGRPLLPAEPSPHHWVDYSLESSPLLSCSIP

SEQ ID NO: 70560 - protein, 215 aa, Homo sapiens
  Payload ID: 13997
  Gene Symbol: RABL6
  Gene Name: RAB, member RAS oncogene family-like 6
  ENSP ID: ENSP00000412757
  MOD_RES (1)..(1): Any amino acid
XKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDSRPPGSSYFRYAESSMKNSFGLKYLHKFFNIPFLQLQVSTHHVGWSGCWSLTSFQVSPV

SEQ ID NO: 70561 - protein, 190 aa, Homo sapiens
  Payload ID: 13997
  Gene Symbol: RABL6
  Gene Name: RAB, member RAS oncogene family-like 6
  ENSP ID: ENSP00000414081
MAGPGTVCWGTVCQGEVLALWGHLQKGTRLSCLAGLSRVLWPQEPAGGGRAVRTHSCGPRGDPWHQGKGLSLASFFLSESRPPGSSYFRYAESSMKNSFGLKYLHKFFNIPFLQLQRETLLRQLETNQLDMDATLEELSVQQETEDQNYGMYVAGPARAGGVGAAGVAVVQGHGLHQGDSRGECPLFGVN

SEQ ID NO: 70562 - protein, 471 aa, Homo sapiens
  Payload ID: 13997
  Gene Symbol: RABL6
  Gene Name: RAB, member RAS oncogene family-like 6
  ENSP ID: ENSP00000431675
MTVGTVKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSGEAQQHQAPC

SEQ ID NO: 70563 - protein, 484 aa, Homo sapiens
  Payload ID: 13997
  Gene Symbol: RABL6
  Gene Name: RAB, member RAS oncogene family-like 6
  ENSP ID: ENSP00000433031
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVRRSAAAPGPLLRWSRGRVSRPPRRRVTPRDPLLHKCCPSSWMTPTLRARDQTHSAGRMTFPCEMTPPM

SEQ ID NO: 70564 - protein, 471 aa, Homo sapiens; identical to SEQ ID NO: 70562
  Payload ID: 13997
  Gene Symbol: RABL6
  Gene Name: RAB, member RAS oncogene family-like 6
  ENSP ID: ENSP00000486100

SEQ ID NO: 70565 - protein, 730 aa, Homo sapiens
  Payload ID: 13998
  Gene Symbol:
  Gene Name: RAB, member RAS oncogene family-like 6 [Source:EntrezGene
  Acc:55684]
  ENSP ID: ENSP00000395490
MFSALKKLVGSDQAPGRDKNIPAGLQSMNQALQRRFAKGVQYNMKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDSRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGRHPGGGDYEEL

SEQ ID NO: 70566 - protein, 200 aa, Homo sapiens
  Payload ID: 13999
  Gene Symbol: RAB10
  Gene Name: RAB10, member RAS oncogene family
  Uniprot ID: P61026
  ENSP ID: ENSP00000264710
MAKKTYDLLFKLLLIGDSGVGKTCVLFRFSDDAFNTTFISTIGIDFKIKTVELQGKKIKLQIWDTAGQERFHTITTSYYRGAMGIMLVYDITNGKSFENISKWLRNIDEHANEDVERMLLGNKCDMDDKRVVPKGKGEQIAREHGIRFFETSAKANINIEKAFLTLAEDILRKTPVKEPNSENVDISSGGGVTGWKSKCC

SEQ ID NO: 70567 - protein, 649 aa, Homo sapiens
  Payload ID: 14000
  Gene Symbol: RAB11FIP1
  Gene Name: RAB11 family interacting protein 1 (class I)
  Uniprot ID: Q6WKZ4
  ENSP ID: ENSP00000287263
MSLMVSAGRGLGAVWSPTHVQVTVLQARGLRAKGPGGTSDAYAVIQVGKEKYATSVSERSLGAPVWREEATFELPSLLSSGPAAAATLQLTVLHRALLGLDKFLGRAEVDLRDLHRDQGRRKTQWYKLKSKPGKKDKERGEIEVDIQFMRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNAMATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 70568 - protein, 1283 aa, Homo sapiens [sequence omitted]

SEQ ID NO: 70569 - protein, 501 aa, Homo sapiens
  Payload ID: 14000
  Gene Symbol: RAB11FIP1
  Gene Name: RAB11 family interacting protein 1 (class I)
  ENSP ID: ENSP00000430009
MRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNAMATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 70570 - protein, 439 aa, Homo sapiens
  Payload ID: 14000
  Gene Symbol: RAB11FIP1
  Gene Name: RAB11 family interacting protein 1 (class I)
  Uniprot ID: Q6WKZ4
  ENSP ID: ENSP00000430680
MRNNMTASMFDLSMKDKSRNPFGKLKDKIKGKNKDSGSDTASAIIPSTTPSVDSDDESVVKDKKKKSKIKTLLSKSNLQKTPLSQSMSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNAMATKVANCSLGTATIISENLNNEVMMKVCPLRSWCVR

SEQ ID NO: 70571 - protein, 512 aa, Homo sapiens
  Payload ID: 14001
  Gene Symbol: RAB11FIP2
  Gene Name: RAB11 family interacting protein 2 (class I)
  Uniprot ID: Q7L804
  ENSP ID: ENSP00000347839
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPQRLSSAHSMSDLSGSHMSSEKLKAGTIGQTHLLGHQLDSFGTVPESGSLKSPHRRTLSFDTSKMNQPDSIVDEGELCFGRQNDPFTNVTASLPQKFATLPRKKNPFEESSETWDSSMNLFSKPIEIRKENKREKREKVSLFERVTGKKDSRRSDKLNNGGSDSPCDLKSPNAFSENRQDYFDYESTNPFTAKFRASNIMPSSSFHMSPTSNEDLRKIPDSNPFDATAGYRSLTYEEVLQELVKHKELLRRKDTHIRELEDYIDNLLVRVMEETPSILRVPYEPSRKAGKFSNS

SEQ ID NO: 70572 - protein, 532 aa, Homo sapiens
  Payload ID: 14001
  Gene Symbol: RAB11FIP2
  Gene Name: RAB11 family interacting protein 2 (class I)
  Uniprot ID: Q7L804
  ENSP ID: ENSP00000358200
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPQRLSSAHSMSDLSGSHMSSEKLKAGTIGQTHLLGHQLDSFGTVPESGSLKSPHRRTLSFDTSKMNQPDSIVDEGELCFGRQNDPFTNVTASLPQKFATLPRKKNPFEESSETWDSSMNLFSKPIEIRKENKREKREKVSLFERVTGKKDSRRSDKLNNGGSDSPCDLKSPNAFSENRQDYFDYESTNPFTAKFRASNIMPSSRNTLLTPAVAEWRGSLRWAELFHMSPTSNEDLRKIPDSNPFDATAGYRSLTYEEVLQELVKHKELLRRKDTHIRELEDYIDNLLVRVMEETPSILRVPYEPSRKAGKFSNS

SEQ ID NO: 70573 - protein, 756 aa, Homo sapiens
  Payload ID: 14002
  Gene Symbol: RAB11FIP3
  Gene Name: RAB11 family interacting protein 3 (class II)
  Uniprot ID: O75154
  ENSP ID: ENSP00000262305
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 70574 - protein, 182 aa, Homo sapiens
  Payload ID: 14002
  Gene Symbol: RAB11FIP3
  Gene Name: RAB11 family interacting protein 3 (class II)
  ENSP ID: ENSP00000399614
MGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPELMEGPEEDIADKVVFLERRVLELEKDTAATGEQHSRLRQ

SEQ ID NO: 70575 - protein, 677 aa, Homo sapiens
  Payload ID: 14002
  Gene Symbol: RAB11FIP3
  Gene Name: RAB11 family interacting protein 3 (class II)
  ENSP ID: ENSP00000399644
WTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSTDPLAAKLHSILTDEAFEFYCSQCHKQINRLEDLSARLSDLEMNSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 70576 - protein, 157 aa, Homo sapiens
  Payload ID: 14002
  Gene Symbol: RAB11FIP3
  Gene Name: RAB11 family interacting protein 3 (class II)
  ENSP ID: ENSP00000404331
MPFLKANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPE

SEQ ID NO: 70577 - protein, 136 aa, Homo sapiens
  Payload ID: 14002
  Gene Symbol: RAB11FIP3
  Gene Name: RAB11 family interacting protein 3 (class II)
  ENSP ID: ENSP00000412502
GGSAVPSECLDAMEEPDHGALLLLPGRPHPHGQSVITVIGGEEHFEDYGEGSEAELSPETLCNGQLGCSDPAFLTPSTDPLAAKLHSILTDEAFEFYCSQCHKQINRLEDLSARLSDLEMNSPTKRLSSKKVASFV

SEQ ID NO: 70578 - protein, 460 aa, Homo sapiens
  Payload ID: 14002
  Gene Symbol: RAB11FIP3
  Gene Name: RAB11 family interacting protein 3 (class II)
  Uniprot ID: O75154
  ENSP ID: ENSP00000415919
MPFLKANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 70579 - protein, 756 aa, Homo sapiens; identical to SEQ ID NO: 70573
  Payload ID: 14002
  Gene Symbol: RAB11FIP3
  Gene Name: RAB11 family interacting protein 3 (class II)
  Uniprot ID: O75154
  ENSP ID: ENSP00000482156

SEQ ID NO: 70580 - protein, 460 aa, Homo sapiens; identical to SEQ ID NO: 70578
  Payload ID: 14002
  Gene Symbol: RAB11FIP3
  Gene Name: RAB11 family interacting protein 3 (class II)
  Uniprot ID: O75154
  ENSP ID: ENSP00000484620

SEQ ID NO: 70581 - protein, 157 aa, Homo sapiens; identical to SEQ ID NO: 70576
  Payload ID: 14002
  Gene Symbol: RAB11FIP3
  Gene Name: RAB11 family interacting protein 3 (class II)
  ENSP ID: ENSP00000488023

SEQ ID NO: 70582 - protein, 677 aa, Homo sapiens; identical to SEQ ID NO: 70575
  Payload ID: 14002
  Gene Symbol: RAB11FIP3
  Gene Name: RAB11 family interacting protein 3 (class II)
  ENSP ID: ENSP00000488133

SEQ ID NO: 70583 - protein, 136 aa, Homo sapiens; identical to SEQ ID NO: 70577
  Payload ID: 14002
  Gene Symbol: RAB11FIP3
  Gene Name: RAB11 family interacting protein 3 (class II)
  ENSP ID: ENSP00000488615

SEQ ID NO: 70584 - protein, 182 aa, Homo sapiens; identical to SEQ ID NO: 70574
  Payload ID: 14002
  Gene Symbol: RAB11FIP3
  Gene Name: RAB11 family interacting protein 3 (class II)
  ENSP ID: ENSP00000488688

SEQ ID NO: 70585 - protein, 535 aa, Homo sapiens
  Payload ID: 14003
  Gene Symbol: RAB11FIP4
  Gene Name: RAB11 family interacting protein 4 (class II)
  Uniprot ID: Q86YS3
  ENSP ID: ENSP00000378227
MRTPPALGSQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMVKDQETTAEQALEEEARRHREAYGKLEREKATEVELLNARVQQLEEENTELRTTVTRLKSQTEKLDEERQRMSDRLEDTSLRLKDEMDLYKRMMDKLRQNRLEFQKEREATQELIEDLRKELEHLQMYKLDCERPGRGRSASSGLGEFNARAREVELEHEVKRLKQENYKLRDQNDDLNGQILSLSLYEAKNLFAAQTKAQSLAAEIDTASRDELMEALKEQEEINFRLRQYMDKIILAILDHNPSILEIKH

SEQ ID NO: 70586 - protein, 163 aa, Homo sapiens
  Payload ID: 14003
  Gene Symbol: RAB11FIP4
  Gene Name: RAB11 family interacting protein 4 (class II)
  ENSP ID: ENSP00000463206
MADTDPRVRVEKLVKYLDPNDLGRINFKDFCRGVFAMKGCEELLKDVLSVESAGTLPCAPEIPDCVEQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTT

SEQ ID NO: 70587 - protein, 50 aa, Homo sapiens
  Payload ID: 14003
  Gene Symbol: RAB11FIP4
  Gene Name: RAB11 family interacting protein 4 (class II)
  ENSP ID: ENSP00000463616
MRTPPALGSQVSGGPGAGARRAPAARTWLGPARGPGKLAESGLGLGGRVT

SEQ ID NO: 70588 - protein, 126 aa, Homo sapiens
  Payload ID: 14003
  Gene Symbol: RAB11FIP4
  Gene Name: RAB11 family interacting protein 4 (class II)
  ENSP ID: ENSP00000465929
MRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMV

SEQ ID NO: 70589 - protein, 50 aa, Homo sapiens
  Payload ID: 14003
  Gene Symbol: RAB11FIP4
  Gene Name: RAB11 family interacting protein 4 (class II)
  ENSP ID: ENSP00000466538
MRTPPALGSQHQPEVPQPVCARSRTEPNLPKSLSLHIFKPRSLKPAQETW

SEQ ID NO: 70590 - protein, 637 aa, Homo sapiens
  Payload ID: 14003
  Gene Symbol: RAB11FIP4
  Gene Name: RAB11 family interacting protein 4 (class II)
  Uniprot ID: Q86YS3
  ENSP ID: ENSP00000482620
MAGGAGWSGAPAALLRSVRRLREVFEVCGRDPDGFLRVERVAALGLRFGQGEEVEKLVKYLDPNDLGRINFKDFCRGVFAMKGCEELLKDVLSVESAGTLPCAPEIPDCVEQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMVKDQETTAEQALEEEARRHREAYGKLEREKATEVELLNARVQQLEEENTELRTTVTRLKSQTEKLDEERQRMSDRLEDTSLRLKDEMDLYKRMMDKLRQNRLEFQKEREATQELIEDLRKELEHLQMYKLDCERPGRGRSASSGLGEFNARAREVELEHEVKRLKQENYKLRDQNDDLNGQILSLSLYEAKNLFAAQTKAQSLAAEIDTASRDELMEALKEQEEINFRLRQYMDKIILAILDHNPSILEIKH

SEQ ID NO: 70591 - protein, 653 aa, Homo sapiens
  Payload ID: 14004
  Gene Symbol: RAB11FIP5
  Gene Name: RAB11 family interacting protein 5 (class I)
  Uniprot ID: Q9BXF6
  ENSP ID: ENSP00000258098
MALVRGAEPAAGPSRWLPTHVQVTVLRARGLRGKSSGAGSTSDAYTVIQVGREKYSTSVVEKTHGCPEWREECSFELPPGALDGLLRAQEADAGPAPWAASSAAACELVLTTMHRSLIGVDKFLGQATVALDEVFGAGRAQHTQWYKLHSKPGKKEKERGEIEVTIQFTRNNLSASMFDLSMKDKPRSPFSKIRDKMKGKKKYDLESASAILPSSAIEDPDLGSLGKMGKAKGFFLRNKLRKSSLTQSNTSLGSDSTLSSASGSLAYQGPGAELLTRSPSRSSWLSTEGGRDSAQSPKLFTHKRTYSDEANQMRVAPPRALLDLQGHLDAASRSSLCVNGSHIYNEEPQGPVRHRSSISGSLPSSGSLQAVSSRFSEEGPRSTDDTWPRGSRSNSSSEAVLGQEELSAQAKVLAPGASHPGEEEGARLPEGKPVQVATPIVASSEAVAEKEGARKEERKPRMGLFHHHHQGLSRSELGRRSSLGEKGGPILGASPHHSSSGEEKAKSSWFGLREAKDPTQKPSPHPVKPLSAAPVEGSPDRKQSRSSLSIALSSGLEKLKTVTSGSIQPVTQAPQAGQMVDTKRLKDSAVLDQSAKYYHLTHDELISLLLQRERELSQRDEHVQELESYIDRLLVRIMETSPTLLQIPPGPPK

SEQ ID NO: 70592 - protein, 216 aa, Homo sapiens
  Payload ID: 14005
  Gene Symbol: RAB11A
  Gene Name: RAB11A, member RAS oncogene family
  Uniprot ID: P62491
  ENSP ID: ENSP00000261890
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 70593 - protein, 155 aa, Homo sapiens
  Payload ID: 14005
  Gene Symbol: RAB11A
  Gene Name: RAB11A, member RAS oncogene family
  ENSP ID: ENSP00000454381
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEIYRIVSQKQMS

SEQ ID NO: 70594 - protein, 81 aa, Homo sapiens
  Payload ID: 14005
  Gene Symbol: RAB11A
  Gene Name: RAB11A, member RAS oncogene family
  ENSP ID: ENSP00000454673
MLVGNKSDLRHLRAVPTDEARAFAEKNGLSFIETSALDSTNVEAAFQTILTEIYRIVSQKQMSDRRENDMSPSNNVVPIHV

SEQ ID NO: 70595 - protein, 146 aa, Homo sapiens
  Payload ID: 14005
  Gene Symbol: RAB11A
  Gene Name: RAB11A, member RAS oncogene family
  ENSP ID: ENSP00000455567
MGTRDDEYDYLFKVVLIGDSGVGKSNLTYENVERWLKELRDHADSNIVIMLVGNKSDLRHLRAVPTDEARAFAEKNGLSFIETSALDSTNVEAAFQTILTEIYRIVSQKQMSDRRENDMSPSNNVVPIHVPPTTENKPKVQCCQNI

SEQ ID NO: 70596 - protein, 155 aa, Homo sapiens
  Payload ID: 14005
  Gene Symbol: RAB11A
  Gene Name: RAB11A, member RAS oncogene family
  Uniprot ID: P62491
  ENSP ID: ENSP00000456420
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNEANVRQTRK

SEQ ID NO: 70597 - protein, 198 aa, Homo sapiens
  Payload ID: 14005
  Gene Symbol: RAB11A
  Gene Name: RAB11A, member RAS oncogene family
  ENSP ID: ENSP00000456638
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEAAFQTILTEIYRIVSQKQMSDRRENDMSPSNNVVPIHVPPTTENKPKVQCCQNI

SEQ ID NO: 70598 - protein, 218 aa, Homo sapiens
  Payload ID: 14006
  Gene Symbol: RAB11B
  Gene Name: RAB11B, member RAS oncogene family
  Uniprot ID: Q15907
  ENSP ID: ENSP00000333547
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 70599 - protein, 179 aa, Homo sapiens
  Payload ID: 14006
  Gene Symbol: RAB11B
  Gene Name: RAB11B, member RAS oncogene family
  Uniprot ID: Q15907
  ENSP ID: ENSP00000471148
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTGGRGPDGCG

SEQ ID NO: 70600 - protein, 60 aa, Homo sapiens
  Payload ID: 14006
  Gene Symbol: RAB11B
  Gene Name: RAB11B, member RAS oncogene family
  ENSP ID: ENSP00000472473
MLVGNKSDLRHLRAVPTDEARAFAEKNNLSFIETSALDSTNVEEAFKNILTGGRGPDGCG

SEQ ID NO: 70601 - protein, 46 aa, Homo sapiens
  Payload ID: 14006
  Gene Symbol: RAB11B
  Gene Name: RAB11B, member RAS oncogene family
  ENSP ID: ENSP00000473042
MLVGNKSDLRHLRAVPTDEARAFAEKNNLSFIETSALDSTNVEEAF

SEQ ID NO: 70602 - protein, 244 aa, Homo sapiens
  Payload ID: 14007
  Gene Symbol: RAB12
  Gene Name: RAB12, member RAS oncogene family
  Uniprot ID: Q6IQ22
  ENSP ID: ENSP00000331748
MDPGAALQRRAGGGGGLGAGSPALSGGQGRRRKQPPRPADFKLQVIIIGSRGVGKTSLMERFTDDTFCEACKSTVGVDFKIKTVELRGKKIRLQIWDTAGQERFNSITSAYYRSAKGIILVYDITKKETFDDLPKWMKMIDKYASEDAELLLVGNKLDCETDREITRQQGEKFAQQITGMRFCEASAKDNFNVDEIFLKLVDDILKKMPLDILRNELSNSILSLQPEPEIPPELPPPRPHVRCC

SEQ ID NO: 70603 - protein, 203 aa, Homo sapiens
  Payload ID: 14008
  Gene Symbol: RAB13
  Gene Name: RAB13, member RAS oncogene family
  Uniprot ID: P51153
  ENSP ID: ENSP00000357564
MAKAYDHLFKLLLIGDSGVGKTCLIIRFAEDNFNNTYISTIGIDFKIRTVDIEGKKIKLQVWDTAGQERFKTITTAYYRGAMGIILVYDITDEKSFENIQNWMKSIKENASAGVERLLLGNKCDMEAKRKVQKEQADKLAREHGIRFFETSAKSSMNVDEAFSSLARDILLKSGGRRSGNGNKPPSTDLKTCDKKNTNKCSLG

SEQ ID NO: 70604 - protein, 122 aa, Homo sapiens
  Payload ID: 14008
  Gene Symbol: RAB13
  Gene Name: RAB13, member RAS oncogene family
  ENSP ID: ENSP00000480103
MGIILVYDITDEKSFENIQNWMKSIKENASAGVERLLLGNKCDMEAKRKVQKEQADKLAREHGIRFFETSAKSSMNVDEAFSSLARDILLKSGGRRSGNGNKPPSTDLKTCDKKNTNKCSLG

SEQ ID NO: 70605 - protein, 215 aa, Homo sapiens
  Payload ID: 14009
  Gene Symbol: RAB14
  Gene Name: RAB14, member RAS oncogene family
  Uniprot ID: P61106
  ENSP ID: ENSP00000362946
MATAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEASAKTGENVEDAFLEAAKKIYQNIQDGSLDLNAAESGVQHKPSAPQGGRLTSEPQPQREGCGC

SEQ ID NO: 70606 - protein, 181 aa, Homo sapiens
  Payload ID: 14009
  Gene Symbol: RAB14
  Gene Name: RAB14, member RAS oncogene family
  ENSP ID: ENSP00000400107
MATAPYNYSYIFKYIIIGDMGVGKSCLLHQFTEKKFMADCPHTIGVEFGTRIIEVSGQKIKLQIWDTAGQERFRAVTRSYYRGAAGALMVYDITRRSTYNHLSSWLTDARNLTNPNTVIILIGNKADLEAQRDVTYEEAKQFAEENGLLFLEASAKTGENVEDAFLEAAKKIYQNIQDGSL

SEQ ID NO: 70607 - protein, 236 aa, Homo sapiens
  Payload ID: 14010
  Gene Symbol: REP15
  Gene Name: RAB15 effector protein
  Uniprot ID: Q6BDI9
  ENSP ID: ENSP00000310335
MGQKASQQLALKDSKEVPVVCEVVSEAIVHAAQKLKEYLGFEYPPSKLCPAANTLNEIFLIHFITFCQEKGVDEWLTTTKMTKHQAFLFGADWIWTFWGSNKQIKLQLAVQTLQMSSPPPVESKPCDLSNPESRVEESSWKKSRFDKLEEFCNLIGEDCLGLFIIFGMPGKPKDIRGVVLDSVKSQMVRSHLPGGKAVAQFVLETEDCVFIKELLRNCLSKKDGLREVGKVYISIL

SEQ ID NO: 70608 - protein, 208 aa, Homo sapiens
  Payload ID: 14011
  Gene Symbol: RAB15
  Gene Name: RAB15, member RAS oncogene family
  Uniprot ID: P59190
  ENSP ID: ENSP00000267512
MAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEVGDATSLPGCGEGASPGKARRGPDGKANASRKLCLPQPWMKTSGTHQKASRRSLLGIRLMRSRNGRWEESKGSSWRRSMAWTSMKQVPAPTSTLKSHSRV

SEQ ID NO: 70609 - protein, 166 aa, Homo sapiens
  Payload ID: 14011
  Gene Symbol: RAB15
  Gene Name: RAB15, member RAS oncogene family
  ENSP ID: ENSP00000433485
MKTIEVDGIKVRIQIWDTAGQERYQTITKQYYRRAQGIFLVYDISSERSYQHIMKWVSDVDEYAPEGVQKILIGNKADEEQKRQVGREQGQQLAKEYGMDFYETSACTNLNIKESFTRLTELVLQAHRKELEGLRMRASNELALAELEEEEGKPEGPANSSKTCWC

SEQ ID NO: 70610 - protein, 212 aa, Homo sapiens
  Payload ID: 14011
  Gene Symbol: RAB15
  Gene Name: RAB15, member RAS oncogene family
  Uniprot ID: P59190
  ENSP ID: ENSP00000434103
MAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEYAPEGVQKILIGNKADEEQKRQVGREQGQQLAKEYGMDFYETSACTNLNIKESFTRLTELVLQAHRKELEGLRMRASNELALAELEEEEGKPEGPANSSKTCWC

SEQ ID NO: 70611 - protein, 150 aa, Homo sapiens
  Payload ID: 14011
  Gene Symbol: RAB15
  Gene Name: RAB15, member RAS oncogene family
  ENSP ID: ENSP00000452195
MKTIEVDGIKVRIQIWDTAGQERYQTITKQYYRRAQGIFLVYDISSERSYQHIMKWVSDVDEYAPEGVQKILIGNKADEEQKRQVGREQGQQLAKEYGMDFYETSACTNLNIKESFTRLTELVLQAHRKELEGLRMRASNELALAELEEE

SEQ ID NO: 70612 - protein, 140 aa, Homo sapiens
  Payload ID: 14011
  Gene Symbol: RAB15
  Gene Name: RAB15, member RAS oncogene family
  ENSP ID: ENSP00000464662
  MOD_RES (1)..(1): Any amino acid
XPRPQLGRNCQPLRLEAVAPEAGVRDKSRGVDFKMKTIEVDGIKVRIQIWDTAGQERYQTITKQYYRRAQGIFLVYDISSERSYQHIMKWVSDVDEVGDATSLPGCGEGASPGKARRGPDGKANASRKLCLPQPWMKTSG

SEQ ID NO: 70613 - protein, 212 aa, Homo sapiens
  Payload ID: 14012
  Gene Symbol: RAB17
  Gene Name: RAB17, member RAS oncogene family
  Uniprot ID: Q9H0T7
  ENSP ID: ENSP00000264601
MAQAHRTPQPRAAPSQPRVFKLVLLGSGSVGKSSLALRYVKNDFKSILPTVGCAFFTKVVDVGATSLKLEIWDTAGQEKYHSVCHLYFRGANAALLVYDITRKDSFLKAQQWLKDLEEELHPGEVLVMLVGNKTDLSQEREVTFQEGKEFADSQKLLFMETSAKLNHQVSEVFNTVAQELLQRSDEEGQALRGDAAVALNKGPARQAKCCAH

SEQ ID NO: 70614 - protein, 52 aa, Homo sapiens
  Payload ID: 14012
  Gene Symbol: RAB17
  Gene Name: RAB17, member RAS oncogene family
  ENSP ID: ENSP00000375858
MAQAHRTPQPRAAPSQPRVFKLVLLGSGSVGKSSLALRYVKNDFKSILPTVG

SEQ ID NO: 70615 - protein, 85 aa, Homo sapiens
  Payload ID: 14012
  Gene Symbol: RAB17
  Gene Name: RAB17, member RAS oncogene family
  Uniprot ID: Q9H0T7
  ENSP ID: ENSP00000386589
MLVGNKTDLSQEREVTFQEGKEFADSQKLLFMETSAKLNHQVSEVFNTVAQELLQRSDEEGQALRGDAAVALNKGPARQAKCCAH

SEQ ID NO: 70616 - protein, 53 aa, Homo sapiens
  Payload ID: 14012
  Gene Symbol: RAB17
  Gene Name: RAB17, member RAS oncogene family
  ENSP ID: ENSP00000386792
MAQMEVVVPGRNGAMTDCGVGPGFPHLGEVAPGKGSWGQWRQFPSMVSRLAMW

SEQ ID NO: 70617 - protein, 54 aa, Homo sapiens
  Payload ID: 14012
  Gene Symbol: RAB17
  Gene Name: RAB17, member RAS oncogene family
  ENSP ID: ENSP00000389332
MAQAHRTPQPRAAPSQPRVFKLVLLGSGSVGKSSLALRCVLHKGGGCGCHLSEA

SEQ ID NO: 70618 - protein, 130 aa, Homo sapiens
  Payload ID: 14012
  Gene Symbol: RAB17
  Gene Name: RAB17, member RAS oncogene family
  ENSP ID: ENSP00000400240
MAQAHRTPQPRAAPSQPRVFKLVLLGSGSVGAFFTKVVDVGATSLKLEIWDTAGQEKYHSVCHLYFRGANAALLVYDITRKDSFLKAQQWLKDLEEELHPGEVLVMLVGNKTDLSQEREVTFQEGKEFAD

SEQ ID NO: 70619 - protein, 140 aa, Homo sapiens
  Payload ID: 14012
  Gene Symbol: RAB17
  Gene Name: RAB17, member RAS oncogene family
  ENSP ID: ENSP00000401495
  MOD_RES (1)..(1): Any amino acid
XFKLVLLGSGSVGAFFTKVVDVGATSLKLEIWDTAGQEKYHSVCHLYFRGANAALLVYDITRKDSFLKAQQWLKDLEEELHPGEVLVMLVGNKTDLSQEREVTFQDEDRVNSCRQVADGETPHTLEAGAGEDPTQGLDRR

SEQ ID NO: 70620 - protein, 206 aa, Homo sapiens
  Payload ID: 14013
  Gene Symbol: RAB18
  Gene Name: RAB18, member RAS oncogene family
  Uniprot ID: Q9NP72
  ENSP ID: ENSP00000349415
MDEDVLTTLKILIIGESGVGKSSLLLRFTDDTFDPELAATIGVDFKVKTISVDGNKAKLAIWDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 70621 - protein, 161 aa, Homo sapiens
  Payload ID: 14013
  Gene Symbol: RAB18
  Gene Name: RAB18, member RAS oncogene family
  ENSP ID: ENSP00000364960
MDEDVLTTLKILIIGESGVGKSSLLLRFTDDTFDPELAATIVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 70622 - protein, 291 aa, Homo sapiens
  Payload ID: 14013
  Gene Symbol: RAB18
  Gene Name: RAB18, member RAS oncogene family
  ENSP ID: ENSP00000407872
  MOD_RES (1)..(1): Any amino acid
XRLPGSRPLPGPSSLGRSPSCSAEKTPFRGPPLGRQSAVKELDLVTAGKFRFSVRSECFSRGPPLKIKCNCYFSFCHILWRQKISVVLSFFTFSLGKIILTVELSISLLLRFTDDTFDPELAATIGVDFKVKTISVDGNKAKLAIWVTLHQQTANFFLKSQIGNSPILKWAMWQYDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWES

SEQ ID NO: 70623 - protein, 142 aa, Homo sapiens
  Payload ID: 14013
  Gene Symbol: RAB18
  Gene Name: RAB18, member RAS oncogene family
  Uniprot ID: Q9NP72
  ENSP ID: ENSP00000439321
MDEDVLTTLKILIIGESGVGKSSLLLRFTDDTFDPELAATIGVDFKVKTISVDGNKAKLAIWENREVDRNEGLKFARKHSMLFIEASAKTCDGVQCAFEELVEKIIQTPGLWESENQNKGVKLSHREEGQGGGACGGYCSVL

SEQ ID NO: 70624 - protein, 235 aa, Homo sapiens
  Payload ID: 14013
  Gene Symbol: RAB18
  Gene Name: RAB18, member RAS oncogene family
  Uniprot ID: Q9NP72
  ENSP ID: ENSP00000478479
MDEDVLTTLKILIIGESGVGKSSLLLRFTDDTFDPELAATIGVDFKVKTISVDGNKAKLAIWVTLHQQTANFFLKSQIGNSPILKWAMWQYDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 70625 - protein, 182 aa, Homo sapiens
  Payload ID: 14013
  Gene Symbol: RAB18
  Gene Name: RAB18, member RAS oncogene family
  ENSP ID: ENSP00000483927
MDEDVLTTLKILIIGESGVGKSSLLLRFTDDTFDPELADTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 70626 - protein, 217 aa, Homo sapiens
  Payload ID: 14014
  Gene Symbol: RAB19
  Gene Name: RAB19, member RAS oncogene family
  Uniprot ID: A4D1S5
  ENSP ID: ENSP00000348778
MHFSSSARAADENFDYLFKIILIGDSNVGKTCVVQHFKSGVYTETQQNTIGVDFTVRSLDIDGKKVKMQVWDTAGQERFRTITQSYYRSAHAAIIAYDLTRRSTFESIPHWIHEIEKYGAANVVIMLIGNKCDLWEKRHVLFEDACTLAEKYGLLAVLETSAKESKNIEEVFVLMAKELIARNSLHLYGESALNGLPLDSSPVLMAQGPSEKTHCTC

SEQ ID NO: 70627 - protein, 149 aa, Homo sapiens
  Payload ID: 14014
  Gene Symbol: RAB19
  Gene Name: RAB19, member RAS oncogene family
  ENSP ID: ENSP00000420782
MHFSSSARAADENFDYLFKIILIGDSNVGKTCVVQHFKSGVYTETQQNTIGVDFTVRSLDIDGKKVKMQVWDTAGQERFRTITQSYYRSAHAAIIAYDLTRRSTFESIPHWIHEIEKYGAANVVIMLIGNKCDLWEKRHVLFEDACTLA

SEQ ID NO: 70628 - protein, 217 aa, Homo sapiens; identical to SEQ ID NO: 70626
  Payload ID: 14014
  Gene Symbol: RAB19
  Gene Name: RAB19, member RAS oncogene family
  Uniprot ID: A4D1S5
  ENSP ID: ENSP00000440167

SEQ ID NO: 70629 - protein, 129 aa, Homo sapiens
  Payload ID: 14015
  Gene Symbol: RAB1A
  Gene Name: RAB1A, member RAS oncogene family
  Uniprot ID: P62820
  ENSP ID: ENSP00000381540
MSSMNPEYDYLFKLLLIGDSGVGKSCLLLRFADDTYTESYISTIGVDFKIRTIELDGKTIKLQIEFADSLGIPFLETSAKNATNVEQSFMTMAAEIKKRMGPGATAGGAEKSNVKIQSTPVKQSGGGCC

SEQ ID NO: 70630 - protein, 141 aa, Homo sapiens
  Payload ID: 14015
  Gene Symbol: RAB1A
  Gene Name: RAB1A, member RAS oncogene family
  Uniprot ID: P62820
  ENSP ID: ENSP00000386451
MSSMNPEYDYLFKLLLIGDSGVGKSCLLLRFAESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 70631 - protein, 173 aa, Homo sapiens
  Payload ID: 14015
  Gene Symbol: RAB1A
  Gene Name: RAB1A, member RAS oncogene family
  ENSP ID: ENSP00000386672
MSSMNPEYDYLFKLLLIGDSGVGKSCLLLRFAWDTAGQERFRTITSSYYRGAHGIIVVYDVTDQESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 70632 - protein, 205 aa, Homo sapiens
  Payload ID: 14015
  Gene Symbol: RAB1A
  Gene Name: RAB1A, member RAS oncogene family
  Uniprot ID: P62820
  ENSP ID: ENSP00000387286
MSSMNPEYDYLFKLLLIGDSGVGKSCLLLRFADDTYTESYISTIGVDFKIRTIELDGKTIKLQIWDTAGQERFRTITSSYYRGAHGIIVVYDVTDQESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 70633 - protein, 201 aa, Homo sapiens
  Payload ID: 14016
  Gene Symbol: RAB1B
  Gene Name: RAB1B, member RAS oncogene family
  Uniprot ID: Q9H0U4
  ENSP ID: ENSP00000310226
MNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 70634 - protein, 169 aa, Homo sapiens
  Payload ID: 14016
  Gene Symbol: RAB1B
  Gene Name: RAB1B, member RAS oncogene family
  ENSP ID: ENSP00000435195
MNPEYDYLFKLLLIGDSGVGKSCLLLRFADDTYTESYISTIGVDFKIRTIELDGKTIKLQIESYANVKQWLQEIDRYASENVNKLLVGNKSDLTTKKVVDNTTAKEFADSLGIPFLETSAKNATNVEQAFMTMAAEIKKRMGPGAASGGERPNLKIDSTPVKPAGGGCC

SEQ ID NO: 70635 - protein, 162 aa, Homo sapiens
  Payload ID: 14016
  Gene Symbol: RAB1B
  Gene Name: RAB1B, member RAS oncogene family
  ENSP ID: ENSP00000477893
MNPEYDYLFKLLLIGDSGVGKSCLLLRFADDTYTESYISTIGVDFKIRTIELDGKTIKLQIWDTAGQERFRTITSSYYRGAHGIIVVYDVTDQESYANVKQGCRRLTAMPARTSISSWWATRATSPPRRWWTTPQPRSLQTLWASPSWRRAPRMPPMSSRRS

SEQ ID NO: 70636 - protein, 234 aa, Homo sapiens
  Payload ID: 14017
  Gene Symbol: RAB20
  Gene Name: RAB20, member RAS oncogene family
  Uniprot ID: Q9NX57
  ENSP ID: ENSP00000267328
MRKPDSKIVLLGDMNVGKTSLLQRYMERRFPDTVSTVGGAFYLKQWRSYNISIWDTAGREQFHGLGSMYCRGAAAIILTYDVNHRQSLVELEDRFLGLTDTASKDCLFAIVGNKVDLTEEGALAGQEKEECSPNMDAGDRVSPRAPKQVQLEDAVALYKKILKYKMLDEQDVPAAEQMCFETSAKTGYNVDLLFETLFDLVVPMILQQRAERPSHTVDISSHKPPKRTRSGCCA

SEQ ID NO: 70637 - protein, 225 aa, Homo sapiens
  Payload ID: 14018
  Gene Symbol: RAB21
  Gene Name: RAB21, member RAS oncogene family
  Uniprot ID: Q9UL25
  ENSP ID: ENSP00000261263
MAAAGGGGGGAAAAGRAYSFKVVLLGEGCVGKTSLVLRYCENKFNDKHITTLQASFLTKKLNIGGKRVNLAIWDTAGQERFHALGPIYYRDSNGAILVYDITDEDSFQKVKNWVKELRKMLGNEICLCIVGNKIDLEKERHVSIQEAESYAESVGAKHYHTSAKQNKGIEELFLDLCKRMIETAQVDERAKGNGSSQPGTARRGVQIIDDEPQAQTSGGGCCSSG

SEQ ID NO: 70638 - protein, 194 aa, Homo sapiens
  Payload ID: 14019
  Gene Symbol: RAB22A
  Gene Name: RAB22A, member RAS oncogene family
  Uniprot ID: Q9UL26
  ENSP ID: ENSP00000244040
MALRELKVCLLGDTGVGKSSIVWRFVEDSFDPNINPTIGASFMTKTVQYQNELHKFLIWDTAGQERFRALAPMYYRGSAAAIIVYDITKEETFSTLKNWVKELRQHGPPNIVVAIAGNKCDLIDVREVMERDAKDYADSIHAIFVETSAKNAININELFIEISRRIPSTDANLPSGGKGFKLRRQPSEPKRSCC

SEQ ID NO: 70639 - protein, 237 aa, Homo sapiens
  Payload ID: 14020
  Gene Symbol: RAB23
  Gene Name: RAB23, member RAS oncogene family
  Uniprot ID: Q9ULC3
  ENSP ID: ENSP00000320413
MLEEDMEVAIKMVVVGNGAVGKSSMIQRYCKGIFTKDYKKTIGVDFLERQIQVNDEDVRLMLWDTAGQEEFDAITKAYYRGAQACVLVFSTTDRESFEAVSSWREKVVAEVGDIPTVLVQNKIDLLDDSCIKNEEAEALAKRLKLRFYRTSVKEDLNVNEVFKYLAEKYLQKLKQQIAEDPELTHSSSNKIGVFNTSGGSHSGQNSGTLNGGDVINLRPNKQRTKKNRNPFSSCSIP

SEQ ID NO: 70640 - protein, 237 aa, Homo sapiens; identical to SEQ ID NO: 70639
  Payload ID: 14020
  Gene Symbol: RAB23
  Gene Name: RAB23, member RAS oncogene family
  Uniprot ID: Q9ULC3
  ENSP ID: ENSP00000417610

SEQ ID NO: 70641 - protein, 174 aa, Homo sapiens
  Payload ID: 14021
  Gene Symbol: RAB24
  Gene Name: RAB24, member RAS oncogene family
  ENSP ID: ENSP00000302085
MAPISSLSLQTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADNIKAQLFETSSKTGQSVDELFQKVAEDYVSVAAFQVMTEDKGVDLGQKPNPYFYSCCHH

SEQ ID NO: 70642 - protein, 203 aa, Homo sapiens
  Payload ID: 14021
  Gene Symbol: RAB24
  Gene Name: RAB24, member RAS oncogene family
  Uniprot ID: Q969Q5
  ENSP ID: ENSP00000304376
MSGQRVDVKVVMLGKEYVGKTSLVERYVHDRFLVGPYQNTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADNIKAQLFETSSKTGQSVDELFQKVAEDYVSVAAFQVMTEDKGVDLGQKPNPYFYSCCHH

SEQ ID NO: 70643 - protein, 203 aa, Homo sapiens; identical to SEQ ID NO: 70642
  Payload ID: 14021
  Gene Symbol: RAB24
  Gene Name: RAB24, member RAS oncogene family
  Uniprot ID: Q969Q5
  ENSP ID: ENSP00000377235

SEQ ID NO: 70644 - protein, 65 aa, Homo sapiens
  Payload ID: 14021
  Gene Symbol: RAB24
  Gene Name: RAB24, member RAS oncogene family
  ENSP ID: ENSP00000421442
MSGQRVDVKVVMLGKEYVGKTSLVERYVHDRFLVGPYQNTIGAAFVAKVMSVGDRTVTLGIWDTA

SEQ ID NO: 70645 - protein, 213 aa, Homo sapiens
  Payload ID: 14022
  Gene Symbol: RAB25
  Gene Name: RAB25, member RAS oncogene family
  Uniprot ID: P57735
  ENSP ID: ENSP00000354376
MGNGTEEDYNFVFKVVLIGESGVGKTNLLSRFTRNEFSHDSRTTIGVEFSTRTVMLGTAAVKAQIWDTAGLERYRAITSAYYRGAVGALLVFDLTKHQTYAVVERWLKELYDHAEATIVVMLVGNKSDLSQAREVPTEEARMFAENNGLLFLETSALDSTNVELAFETVLKEIFAKVSKQRQNSIRTNAITLGSAQAGQEPGPGEKRACCISL

SEQ ID NO: 70646 - protein, 256 aa, Homo sapiens
  Payload ID: 14022
  Gene Symbol: RAB25
  Gene Name: RAB25, member RAS oncogene family
  ENSP ID: ENSP00000482161
MGNGTEEDYNFVFKVVLIGESGVGKTNLLSRFTRNEFSHDSRTTIGVEFSTRTVMLGTAAVKAQIWDTAGLERYRAITSAYYRGAVGALLVFDLTKHQTYAVVERWLKELYDHAEATIVVMLVGNKSDLSQAREVPTEEARMFAENNGLLFLETSALDSTNVELAFETVLKEIFAKVSKQRQNSIRTNAITLGSARLDRSLAWGEEGLLHQPLTLASTTCPHWLFVPLVPTSAPGPFLALWFQISDCSLFTAPSGS

SEQ ID NO: 70647 - protein, 256 aa, Homo sapiens
  Payload ID: 14023
  Gene Symbol: RAB26
  Gene Name: RAB26, member RAS oncogene family
  Uniprot ID: Q9ULW5
  ENSP ID: ENSP00000210187
MSRKKTPKSKGASTPAASTLPTANGARPARSGTALSGPDAPPNGPLQPGRPSLGGGVDFYDVAFKVMLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKEYGLPFMETSAKTGLNVDLAFTAIAKELKQRSMKAPSEPRFRLHDYVKREGRGASCCRP

SEQ ID NO: 70648 - protein, 190 aa, Homo sapiens
  Payload ID: 14023
  Gene Symbol: RAB26
  Gene Name: RAB26, member RAS oncogene family
  Uniprot ID: Q9ULW5
  ENSP ID: ENSP00000441580
MLVGDSGVGKTCLLVRFKDGAFLAGTFISTVGIDFRNKVLDVDGVKVKLQMWDTAGQERFRSVTHAYYRDAHALLLLYDVTNKASFDNIQAWLTEIHEYAQHDVALMLLGNKVDSAHERVVKREDGEKLAKEYGLPFMETSAKTGLNVDLAFTAIAKELKQRSMKAPSEPRFRLHDYVKREGRGASCCRP

SEQ ID NO: 70649 - protein, 64 aa, Homo sapiens
  Payload ID: 14023
  Gene Symbol: RAB26
  Gene Name: RAB26, member RAS oncogene family
  ENSP ID: ENSP00000454373
MLVGDSGVGKTCLLVRFKDGAFLAGTFISTVGIDFRQGLTLSPWLECSGDHGGLQPPTSGFKPS

SEQ ID NO: 70650 - protein, 136 aa, Homo sapiens
  Payload ID: 14023
  Gene Symbol: RAB26
  Gene Name: RAB26, member RAS oncogene family
  ENSP ID: ENSP00000455675
  MOD_RES (1)..(1): Any amino acid
XKEYGLPFMETSAKTGLNVDLAFTAIANNSPNKQASESPWPHTGRHGKAVFCTGRGAASGQTLPRCSAAPSWARPGEGGLGLAPRTVPNPRKAMSSAAHAQAAKGGRLPTPGTEGFTANHIVHLCVLGAACSRPTL

SEQ ID NO: 70651 - protein, 221 aa, Homo sapiens
  Payload ID: 14024
  Gene Symbol: RAB27A
  Gene Name: RAB27A, member RAS oncogene family
  Uniprot ID: P51159
  ENSP ID: ENSP00000337761
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRMERCVDKSWIPEGVVRSNGHASTDQLSEEKEKGACGC

SEQ ID NO: 70652 - protein, 221 aa, Homo sapiens; identical to SEQ ID NO: 70651
  Payload ID: 14024
  Gene Symbol: RAB27A
  Gene Name: RAB27A, member RAS oncogene family
  Uniprot ID: P51159
  ENSP ID: ENSP00000379601

SEQ ID NO: 70653 - protein, 185 aa, Homo sapiens
  Payload ID: 14024
  Gene Symbol: RAB27A
  Gene Name: RAB27A, member RAS oncogene family
  ENSP ID: ENSP00000454695
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRM

SEQ ID NO: 70654 - protein, 221 aa, Homo sapiens; identical to SEQ ID NO: 70651
  Payload ID: 14024
  Gene Symbol: RAB27A
  Gene Name: RAB27A, member RAS oncogene family
  Uniprot ID: P51159
  ENSP ID: ENSP00000455012

SEQ ID NO: 70655 - protein, 221 aa, Homo sapiens; identical to SEQ ID NO: 70651
  Payload ID: 14024
  Gene Symbol: RAB27A
  Gene Name: RAB27A, member RAS oncogene family
  Uniprot ID: P51159
  ENSP ID: ENSP00000456059

SEQ ID NO: 70656 - protein, 136 aa, Homo sapiens
  Payload ID: 14024
  Gene Symbol: RAB27A
  Gene Name: RAB27A, member RAS oncogene family
  ENSP ID: ENSP00000456536
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSD

SEQ ID NO: 70657 - protein, 71 aa, Homo sapiens
  Payload ID: 14024
  Gene Symbol: RAB27A
  Gene Name: RAB27A, member RAS oncogene family
  ENSP ID: ENSP00000457517
MSDGDYDYLIKFLALGDSGVGKTSVLYQYTDGKFNSKFITTVGIDFREKRVVYRASGPDGATGRGQRIHLQ

SEQ ID NO: 70658 - protein, 95 aa, Homo sapiens
  Payload ID: 14024
  Gene Symbol: RAB27A
  Gene Name: RAB27A, member RAS oncogene family
  ENSP ID: ENSP00000457595
MSDGDYDYLIKFLALGDSGVGKTSVLYQYTDGKFNSKFITTVGIDFREKRVVYRASGPDGATGRGQRIHLQLWDTAGQERFRSLTTAFFRDAMGF

SEQ ID NO: 70659 - protein, 146 aa, Homo sapiens
  Payload ID: 14024
  Gene Symbol: RAB27A
  Gene Name: RAB27A, member RAS oncogene family
  ENSP ID: ENSP00000458127
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEE

SEQ ID NO: 70660 - protein, 218 aa, Homo sapiens
  Payload ID: 14025
  Gene Symbol: RAB27B
  Gene Name: RAB27B, member RAS oncogene family
  Uniprot ID: O00194
  ENSP ID: ENSP00000262094
MTDGDYDYLIKLLALGDSGVGKTTFLYRYTDNKFNPKFITTVGIDFREKRVVYNAQGPNGSSGKAFKVHLQLWDTAGQERFRSLTTAFFRDAMGFLLMFDLTSQQSFLNVRNWMSQLQANAYCENPDIVLIGNKADLPDQREVNERQARELADKYGIPYFETSAATGQNVEKAVETLLDLIMKRMEQCVEKTQIPDTVNGGNSGNLDGEKPPEKKCIC

SEQ ID NO: 70661 - protein, 131 aa, Homo sapiens
  Payload ID: 14025
  Gene Symbol: RAB27B
  Gene Name: RAB27B, member RAS oncogene family
  ENSP ID: ENSP00000465009
  MOD_RES (1)..(1): Any amino acid
XFRDAMGFLLMFDLTSQQSFLNVRNWMSQLQANAYCENPDIVLIGNKADLPDQREVNERQARELADKYGCKLSTLGINKFDEACLSLHQWSCSLFCISLHLKRIHNSFLIAYYTKRLREKSSFVKDFGCII

SEQ ID NO: 70662 - protein, 87 aa, Homo sapiens
  Payload ID: 14025
  Gene Symbol: RAB27B
  Gene Name: RAB27B, member RAS oncogene family
  ENSP ID: ENSP00000468542
MTDGDYDYLIKLLALGDSGVGKTTFLYRYTDNKFNPKFITTVGIDFREKRVVYNAQGPNGSSGKAFKVHLQLWDTAGQERFRSLTTA

SEQ ID NO: 70663 - protein, 220 aa, Homo sapiens
  Payload ID: 14026
  Gene Symbol: RAB28
  Gene Name: RAB28, member RAS oncogene family
  Uniprot ID: P51157
  ENSP ID: ENSP00000288723
MSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQRIVRAEIVKYPEEENQHTTSTQSRICSVQ

SEQ ID NO: 70664 - protein, 221 aa, Homo sapiens
  Payload ID: 14026
  Gene Symbol: RAB28
  Gene Name: RAB28, member RAS oncogene family
  Uniprot ID: P51157
  ENSP ID: ENSP00000328551
MSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQRVVKADIVNYNQEPMSRTVNPPRSSMCAVQ

SEQ ID NO: 70665 - protein, 204 aa, Homo sapiens
  Payload ID: 14026
  Gene Symbol: RAB28
  Gene Name: RAB28, member RAS oncogene family
  Uniprot ID: P51157
  ENSP ID: ENSP00000340079
MSDSEEESQDRQLKIVVLGDGASGKTSLTTCFAQETFGKQYKQTIGLDFFLRRITLPGNLNVTLQIWDIGGQTIGGKMLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQGHFIIFISSTNRE

SEQ ID NO: 70666 - protein, 74 aa, Homo sapiens
  Payload ID: 14026
  Gene Symbol: RAB28
  Gene Name: RAB28, member RAS oncogene family
  ENSP ID: ENSP00000422816
  MOD_RES (1)..(1): Any amino acid
XDLEHMRTIKPEKHLRFCQENGFSSHFVSAKTGDSVFLCFQKVAAEILGIKLNKAEIEQSQGHFIIFISSTNRE

SEQ ID NO: 70667 - protein, 95 aa, Homo sapiens
  Payload ID: 14026
  Gene Symbol: RAB28
  Gene Name: RAB28, member RAS oncogene family
  ENSP ID: ENSP00000424043
MSDSEEESQDRQLKIVVLGDGASGKTSLTTCFAQETFGKQYKQTIGLDFFLRRITLPGNLNVTLQIWDIGGQTIGGKMLDKYIYGAQLIWSICEQ

SEQ ID NO: 70668 - protein, 51 aa, Homo sapiens
  Payload ID: 14026
  Gene Symbol: RAB28
  Gene Name: RAB28, member RAS oncogene family
  ENSP ID: ENSP00000424091
  MOD_RES (1)..(1): Any amino acid
XQGVLLVYDITNYQSFENLEDWYTVVKKVSEESETQPLVALVGNKRKQHGL

SEQ ID NO: 70669 - protein, 143 aa, Homo sapiens
  Payload ID: 14026
  Gene Symbol: RAB28
  Gene Name: RAB28, member RAS oncogene family
  ENSP ID: ENSP00000424899
  MOD_RES (1)..(1): Any amino acid
XLDKYIYGAQGVLLVYDITNYQSFENLEDWYTVVKKVSEESETQPLVALVGNKIDLEHMRTIKPEKHLRFCQENGFSSHFVSAKTGDSVFLCFQKVAAEILGIKLNKAEIEQSQRIVRAEIVKYPEEENQHTTSTQSRICSVQ

SEQ ID NO: 70670 - protein, 95 aa, Homo sapiens; identical to SEQ ID NO: 70667
  Payload ID: 14026
  Gene Symbol: RAB28
  Gene Name: RAB28, member RAS oncogene family
  ENSP ID: ENSP00000485808

SEQ ID NO: 70671 - protein, 203 aa, Homo sapiens
  Payload ID: 14027
  Gene Symbol: RAB29
  Gene Name: RAB29, member RAS oncogene family
  Uniprot ID: O14966
  ENSP ID: ENSP00000235932
MGSRDHLFKVLVVGDAAVGKTSLVQRYSQDSFSKHYKSTVGVDFALKVLQWSDYEIVRLQLWDIAGQERFTSMTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 70672 - protein, 203 aa, Homo sapiens; identical to SEQ ID NO: 70671
  Payload ID: 14027
  Gene Symbol: RAB29
  Gene Name: RAB29, member RAS oncogene family
  Uniprot ID: O14966
  ENSP ID: ENSP00000356107

SEQ ID NO: 70673 - protein, 179 aa, Homo sapiens
  Payload ID: 14027
  Gene Symbol: RAB29
  Gene Name: RAB29, member RAS oncogene family
  Uniprot ID: O14966
  ENSP ID: ENSP00000389899
MGSRDHLFKVLVVGDAAVGKTSLVQRYSQDSFSKHYKSTVGGQERFTSMTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 70674 - protein, 203 aa, Homo sapiens; identical to SEQ ID NO: 70671
  Payload ID: 14027
  Gene Symbol: RAB29
  Gene Name: RAB29, member RAS oncogene family
  Uniprot ID: O14966
  ENSP ID: ENSP00000402910

SEQ ID NO: 70675 - protein, 131 aa, Homo sapiens
  Payload ID: 14027
  Gene Symbol: RAB29
  Gene Name: RAB29, member RAS oncogene family
  Uniprot ID: O14966
  ENSP ID: ENSP00000416613
MTRLYYRDASACVIMFDVTNATTFSNSQRWKQDLDSKLTLPNGEPVPCLLLANKCDLSPWAVSRDQIDRFSKENGFTGWTETSVKENKNINEAMRVLIEKMMRNSTEDIMSLSTQGDYINLQTKSSSWSCC

SEQ ID NO: 70676 - protein, 42 aa, Homo sapiens
  Payload ID: 14027
  Gene Symbol: RAB29
  Gene Name: RAB29, member RAS oncogene family
  ENSP ID: ENSP00000431483
MGSRDHLFKVLVVGDAAVGKTSLVQRYSQDSFSKHYKSTVGV

SEQ ID NO: 70677 - protein, 212 aa, Homo sapiens
  Payload ID: 14028
  Gene Symbol: RAB2A
  Gene Name: RAB2A, member RAS oncogene family
  Uniprot ID: P61019
  ENSP ID: ENSP00000262646
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 70678 - protein, 104 aa, Homo sapiens
  Payload ID: 14028
  Gene Symbol: RAB2A
  Gene Name: RAB2A, member RAS oncogene family
  ENSP ID: ENSP00000398054
  MOD_RES (1)..(1): Any amino acid
XRDTFNHLTTWLEDARQHSNSNMVIMLIGNKSDLESRREVKKEEGEAFAREHGLIFMETSAKTASNVEEAFINTAKEIYEKIQEGVFDINNEVYTYKYCWSILI

SEQ ID NO: 70679 - protein, 181 aa, Homo sapiens
  Payload ID: 14028
  Gene Symbol: RAB2A
  Gene Name: RAB2A, member RAS oncogene family
  ENSP ID: ENSP00000431589
MAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKRHLLIQQKKFMKKFKKESLTLIMRQMALKLALSMLLPMQHMQAIREDSRLGAAAVESVFTV

SEQ ID NO: 70680 - protein, 188 aa, Homo sapiens
  Payload ID: 14028
  Gene Symbol: RAB2A
  Gene Name: RAB2A, member RAS oncogene family
  Uniprot ID: P61019
  ENSP ID: ENSP00000431846
MAYAYLFKYIIIGDTGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 70681 - protein, 10 aa, Homo sapiens
  Payload ID: 14028
  Gene Symbol: RAB2A
  Gene Name: RAB2A, member RAS oncogene family
  ENSP ID: ENSP00000432735
MITIDGKQIK

SEQ ID NO: 70682 - protein, 135 aa, Homo sapiens
  Payload ID: 14028
  Gene Symbol: RAB2A
  Gene Name: RAB2A, member RAS oncogene family
  ENSP ID: ENSP00000432855
  MOD_RES (1)..(1): Any amino acid
XFKYIIIGDTGVGKSCLLLQFTDKRFQPVHDLTIGVEFGARMITIDGKQIKLQIWDTGKSKKKHTLPLVSVHWQKKGRGRARILSFHHKVVLQRCSRSFTSLRYYTERYIQPLDNLVRRCPPAFQFQHGHYAYWK

SEQ ID NO: 70683 - protein, 69 aa, Homo sapiens
  Payload ID: 14028
  Gene Symbol: RAB2A
  Gene Name: RAB2A, member RAS oncogene family
  ENSP ID: ENSP00000433875
  MOD_RES (1)..(1): Any amino acid
XVGKSCLLLQFTDKRFQPVHDLTIGTKHLGAQEAETVKSYPAAGAVVLASHLLGWNGHRCRVRCSNDNY

SEQ ID NO: 70684 - protein, 216 aa, Homo sapiens
  Payload ID: 14029
  Gene Symbol: RAB2B
  Gene Name: RAB2B, member RAS oncogene family
  Uniprot ID: Q8WUD1
  ENSP ID: ENSP00000380869
MTYAYLFKYIIIGDTGVGKSCLLLQFTDKRFQPVHDLTIGVEFGARMVNIDGKQIKLQIWDTAGQESFRSITRSYYRGAAGALLVYDITRRETFNHLTSWLEDARQHSSSNMVIMLIGNKSDLESRRDVKREEGEAFAREHGLIFMETSAKTACNVEEAFINTAKEIYRKIQQGLFDVHNEANGIKIGPQQSISTSVGPSASQRNSRDIGSNSGCC

SEQ ID NO: 70685 - protein, 62 aa, Homo sapiens
  Payload ID: 14029
  Gene Symbol: RAB2B
  Gene Name: RAB2B, member RAS oncogene family
  ENSP ID: ENSP00000405441
MTYAYLFKYIIIGDTGVGKSCLLLQFTDKRFQPVHDLTIGVEFGARMVNIDGKQIKLQIWDT

SEQ ID NO: 70686 - protein, 209 aa, Homo sapiens [sequence omitted]

SEQ ID NO: 70687 - protein, 981 aa, Homo sapiens
  Payload ID: 14030
  Gene Symbol: RAB3GAP1
  Gene Name: RAB3 GTPase activating protein subunit 1 (catalytic)
  Uniprot ID: Q15042
  ENSP ID: ENSP00000264158
MAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAGAFSSDTSFF

SEQ ID NO: 70688 - protein, 58 aa, Homo sapiens
  Payload ID: 14030
  Gene Symbol: RAB3GAP1
  Gene Name: RAB3 GTPase activating protein subunit 1 (catalytic)
  ENSP ID: ENSP00000400761
MAADSEPESEVFEITDFTTASEWERFISKVEEVLNDWKLIGNSLGKPLEKVRSICWCL

SEQ ID NO: 70689 - protein, 988 aa, Homo sapiens
  Payload ID: 14030
  Gene Symbol: RAB3GAP1
  Gene Name: RAB3 GTPase activating protein subunit 1 (catalytic)
  Uniprot ID: Q15042
  ENSP ID: ENSP00000411418
MAADSEPESEVFEITDFTTASEWERFISKVEEVLNDWKLIGNSLGKPLEKGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRLTESSDEAAAMTPPEEELKRMGSPEERRQNSVSDFPPPAGREFILRTTVPRPAPYSKALPQRMYSVLTKEDFRLAGAFSSDTSFF

SEQ ID NO: 70690 - protein, 935 aa, Homo sapiens
  Payload ID: 14030
  Gene Symbol: RAB3GAP1
  Gene Name: RAB3 GTPase activating protein subunit 1 (catalytic)
  Uniprot ID: Q15042
  ENSP ID: ENSP00000444306
MFSLISGIFTSGTWEEKSDEISFADFKFSVTHHYLVQESTDKEGKDELLEDVVPQSMQDLLGMNNDFPPRAHCLVRWYGLREFVVIAPAAHSDAVLSESKCNLLLSSVSIALGNTGCQVPLFVQIHHKWRRMYVGECQGPGVRTDFEMVHLRKVPNQYTHLSGLLDIFKSKIGCPLTPLPPVSIAIRFTYVLQDWQQYFWPQQPPDIDALVGGEVGGLEFGKLPFGACEDPISELHLATTWPHLTEGIIVDNDVYSDLDPIQAPHWSVRVRKAENPQCLLGDFVTEFFKICRRKESTDEILGRSAFEEEGKETADITHALSKLTEPASVPIHKLSVSNMVHTAKKKIRKHRGVEESPLNNDVLNTILLFLFPDAVSEKPLDGTTSTDNNNPPSESEDYNLYNQFKSAPSDSLTYKLALCLCMINFYHGGLKGVAHLWQEFVLEMRFRWENNFLIPGLASGPPDLRCCLLHQKLQMLNCCIERKKARDEGKKTSASDVTNIYPGDAGKAGDQLVPDNLKETDKEKGEVGKSWDSWSDSEEEFFECLSDTEELKGNGQESGKKGGPKEMANLRPEGRLYQHGKLTLLHNGEPLYIPVTQEPAPMTEDLLEEQSEVLAKLGTSAEGAHLRARMQSACLLSDMESFKAANPGCSLEDFVRWYSPRDYIEEEVIDEKGNVVLKGELSARMKIPSNMWVEAWETAKPIPARRQRRLFDDTREAEKVLHYLAIQKPADLARHLLPCVIHAAVLKVKEEESLENISSVKKIIKQIISHSSKVLHFPNPEDKKLEEIIHQITNVEALIARARSLKAKFGTEKCEQEEEKEDLERFVSCLLEQPEVLVTGAGRGHAGRIIHKLFVNAQRAAAMTPPEEELKRMGSPEERRQNSVSDFPPPAGREFILRTTVPRPAPYSKALPQRMYSVLTKEDFRLAVKIIDGDV

SEQ ID NO: 70691 - protein, 1393 aa, Homo sapiens
  Payload ID: 14031
  Gene Symbol: RAB3GAP2
  Gene Name: RAB3 GTPase activating protein subunit 2 (non-catalytic)
  Uniprot ID: Q9H2M9
  ENSP ID: ENSP00000351832
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASVGIMTLSPFDQMKTASNIGGFNAAIKNSPPAMSQYITVGSNPFTGFFYALEGSTQPLLSHVALAVASKLTSALFNAASGWLGWKSKHEEEAVQKQKPKVEPATPLAVRFGLPDSRRHGESICLSPCNTLAAVTDDFGRVILLDVARGIAIRMWKGYRDAQIGWIQTVEDLHERVPEKADFSPFGNSQGPSRVAQFLVIYAPRRGILEVWSTQQGPRVGAFNVGKHCRLLYPGYKIMGLNNVTSQSWQPQTYQICLVDPVSGSVKTVNVPFHLALSDKKSERAKDMHLVKKLAALLKTKSPNLDLVETEIKELILDIKYPATKKQALESILASERLPFSCLRNITQTLMDTLKSQELESVDEGLLQFCANKLKLLQLYESVSQLNSLDFHLDTPFSDNDLALLLRLDEKELLKLQALLEKYKQENTRTNVRFSDDKDGVLPVKTFLEYLEYEKDVLNIKKISEEEYVALGSFFFWKCLHGESSTEDMCHTLESAGLSPQLLLSLLLSVWLSKEKDILDKPQSICCLHTMLSLLSKMKVAIDETWDSQSVSPWWQQMRTACIQSENNGAALLSAHVGHSVAAQISNNMTEKKFSQTVLGADSEALTDSWEALSLDTEYWKLLLKQLEDCLILQTLLHSKGNTQTSKVSSLQAEPLPRLSVKKLLEGGKGGIADSVAKWIFKQDFSPEVLKLANEERDAENPDEPKEGVNRSFLEVSEMEMDLGAIPDLLHLAYEQFPCSLELDVLHAHCCWEYVVQWNKDPEEARFFVRSIEHLKQIFNAHVQNGIALMMWNTFLVKRFSAATYLMDKVGKSPKDRLCRRDVGMSDTAMTSFLGSCLDLLQILMEADVSRDEIQVPVLDTEDAWLSVEGPISIVELALEQKHIHYPLVEHHSILCSILYAVMRFSLKTVKPLSLFDSKGKNAFFKDLTSIQLLPSGEMDPNFISVRQQFLLKVVSAAVQAQHSATKVKDPTEEATPTPFGKDQDWPALAVDLAHHLQVSEDVVRRHYVGELYNYGVDHLGEEAILQVHDKEVLASQLLVLTGQRLAHALLHTQTKEGMELLARLPPTLCTWLKAMDPQDLQNTEVPIATTAKLVNKVIELLPEKHGQYGLALHLIEAVEAISLPSL

SEQ ID NO: 70692 - protein, 172 aa, Homo sapiens
  Payload ID: 14031
  Gene Symbol: RAB3GAP2
  Gene Name: RAB3 GTPase activating protein subunit 2 (non-catalytic)
  ENSP ID: ENSP00000418560
  MOD_RES (1)..(1): Any amino acid
XAEAEERERDSRKWLRGDHLSFAQLCIQSVVECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKKWGLQDIDTIIDHASV

SEQ ID NO: 70693 - protein, 82 aa, Homo sapiens
  Payload ID: 14031
  Gene Symbol: RAB3GAP2
  Gene Name: RAB3 GTPase activating protein subunit 2 (non-catalytic)
  ENSP ID: ENSP00000420156
MACSIVQFCYFQDLQAARDFLFPHLREEILSGALRRDPSKSTDWEDDGWGAWEENEPQEPGMCNQCSMYPTSKPKEEFHWAS

SEQ ID NO: 70694 - protein, 203 aa, Homo sapiens
  Payload ID: 14032
  Gene Symbol: RAB30
  Gene Name: RAB30, member RAS oncogene family
  Uniprot ID: Q15771
  ENSP ID: ENSP00000260056
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGNKIDLAERREVSQQRAEEFSEAQDMYYLETSAKESDNVEKLFLDLACRLISEARQNTLVNNVSSPLPGEGKSISYLTCCNFN

SEQ ID NO: 70695 - protein, 139 aa, Homo sapiens
  Payload ID: 14032
  Gene Symbol: RAB30
  Gene Name: RAB30, member RAS oncogene family
  ENSP ID: ENSP00000432193
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGNKIDLAERREVSQQRAEE

SEQ ID NO: 70696 - protein, 114 aa, Homo sapiens
  Payload ID: 14032
  Gene Symbol: RAB30
  Gene Name: RAB30, member RAS oncogene family
  ENSP ID: ENSP00000432336
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNK

SEQ ID NO: 70697 - protein, 94 aa, Homo sapiens
  Payload ID: 14032
  Gene Symbol: RAB30
  Gene Name: RAB30, member RAS oncogene family
  ENSP ID: ENSP00000433243
MSMEDYDFLFKIVLIGNAGVGKTCLVRRFTQLQIWDTAGQERFRSITQSYYRSANALILTYDITCEESFRCLPEWLREIEQYASNKVITVLVGK

SEQ ID NO: 70698 - protein, 167 aa, Homo sapiens
  Payload ID: 14032
  Gene Symbol: RAB30
  Gene Name: RAB30, member RAS oncogene family
  ENSP ID: ENSP00000433832
YCRDIHTKYSSEWGAGALEDKSRLQIWDTAGQERFRSITQSYYRSANALILTYDITCEESFRCLPEWLREIEQYASNKVITVLVGNKIDLAERREVSQQRAEEFSEAQDMYYLETSAKESDNVEKLFLDLACRLISEARQNTLVNNVSSPLPGEGKSISYLTCCNFN

SEQ ID NO: 70699 - protein, 55 aa, Homo sapiens
  Payload ID: 14032
  Gene Symbol: RAB30
  Gene Name: RAB30, member RAS oncogene family
  ENSP ID: ENSP00000434106
MSMEDYDFLFKIVLIGNAGVGKTCLVRRFTQGLFPPGQGATIGVDFMIKTVEING

SEQ ID NO: 70700 - protein, 59 aa, Homo sapiens
  Payload ID: 14032
  Gene Symbol: RAB30
  Gene Name: RAB30, member RAS oncogene family
  ENSP ID: ENSP00000434528
MSMEDYDFLFKIVLIGNAGVGKTCLVRRFTQGLFPPGQGATIGVDFMIKTVEINGEKVK

SEQ ID NO: 70701 - protein, 168 aa, Homo sapiens
  Payload ID: 14032
  Gene Symbol: RAB30
  Gene Name: RAB30, member RAS oncogene family
  ENSP ID: ENSP00000434953
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGNKIDLAERREVSQQRAEEFSEAQDMYYLETSAKESDNVEKLFLDLAC

SEQ ID NO: 70702 - protein, 164 aa, Homo sapiens
  Payload ID: 14032
  Gene Symbol: RAB30
  Gene Name: RAB30, member RAS oncogene family
  Uniprot ID: Q15771
  ENSP ID: ENSP00000434974
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLATRLTWLKGERFPSSELKNSQKLRTCIIWRPQPRNLIMWRNSSLT

SEQ ID NO: 70703 - protein, 203 aa, Homo sapiens; identical to SEQ ID NO: 70694
  Payload ID: 14032
  Gene Symbol: RAB30
  Gene Name: RAB30, member RAS oncogene family
  Uniprot ID: Q15771
  ENSP ID: ENSP00000435089

SEQ ID NO: 70704 - protein, 203 aa, Homo sapiens; identical to SEQ ID NO: 70694
  Payload ID: 14032
  Gene Symbol: RAB30
  Gene Name: RAB30, member RAS oncogene family
  Uniprot ID: Q15771
  ENSP ID: ENSP00000435189

SEQ ID NO: 70705 - protein, 100 aa, Homo sapiens
  Payload ID: 14032
  Gene Symbol: RAB30
  Gene Name: RAB30, member RAS oncogene family
  ENSP ID: ENSP00000435542
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCL

SEQ ID NO: 70706 - protein, 37 aa, Homo sapiens
  Payload ID: 14032
  Gene Symbol: RAB30
  Gene Name: RAB30, member RAS oncogene family
  ENSP ID: ENSP00000436282
MSMEDYDFLFKIVLIGNAGVGKTCLVRRFTQLQIWDT

SEQ ID NO: 70707 - protein, 75 aa, Homo sapiens
  Payload ID: 14032
  Gene Symbol: RAB30
  Gene Name: RAB30, member RAS oncogene family
  ENSP ID: ENSP00000436587
MIKTVEINGEKVKLQIWDTAGQERFRSITQSYYRSANALILTYDITCEESFRCLPEWLREIEQYASNKVITVLVG

SEQ ID NO: 70708 - protein, 122 aa, Homo sapiens
  Payload ID: 14032
  Gene Symbol: RAB30
  Gene Name: RAB30, member RAS oncogene family
  ENSP ID: ENSP00000437235
MSMEDYDFLFKIVLIGNAGVGKTCLVRRFTQGLFPPGQGATIGVDFMIKTVEINGEKVKLQIWDTAGQERFRSITQSYYRSANALILTYDITCEESFRCLPEWLREIEQYASNKVITVLVGK

SEQ ID NO: 70709 - protein, 203 aa, Homo sapiens; identical to SEQ ID NO: 70694
  Payload ID: 14032
  Gene Symbol: RAB30
  Gene Name: RAB30, member RAS oncogene family
  Uniprot ID: Q15771
  ENSP ID: ENSP00000478702

SEQ ID NO: 70710 - protein, 195 aa, Homo sapiens
  Payload ID: 14033
  Gene Symbol: RAB31
  Gene Name: RAB31, member RAS oncogene family
  Uniprot ID: Q13636
  ENSP ID: ENSP00000461945
MMAIRELKVCLLGDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 70711 - protein, 25 aa, Homo sapiens
  Payload ID: 14033
  Gene Symbol: RAB31
  Gene Name: RAB31, member RAS oncogene family
  ENSP ID: ENSP00000462164
MMAIRELKVCLLGGIFYDQNCALWK

SEQ ID NO: 70712 - protein, 59 aa, Homo sapiens
  Payload ID: 14033
  Gene Symbol: RAB31
  Gene Name: RAB31, member RAS oncogene family
  ENSP ID: ENSP00000462561
MMAIRELKVCLLGGLMEPICSLTKCHSIGRTLDKDKEGCIPVAPPGGRWRYVLRTPATG

SEQ ID NO: 70713 - protein, 74 aa, Homo sapiens
  Payload ID: 14033
  Gene Symbol: RAB31
  Gene Name: RAB31, member RAS oncogene family
  ENSP ID: ENSP00000464046
MMAIRELKVCLLGDTGVGKSSIVCRFVQDHFDHNISPTIGASFMTKTVPCGNELHKFLIWDTAGQERGGSPEGC

SEQ ID NO: 70714 - protein, 225 aa, Homo sapiens
  Payload ID: 14034
  Gene Symbol: RAB32
  Gene Name: RAB32, member RAS oncogene family
  Uniprot ID: Q13637
  ENSP ID: ENSP00000356465
MAGGGAGDPGLGAAAAPAPETREHLFKVLVIGELGVGKTSIIKRYVHQLFSQHYRATIGVDFALKVLNWDSRTLVRLQLWDIAGQERFGNMTRVYYKEAVGAFVVFDISRSSTFEAVLKWKSDLDSKVHLPNGSPIPAVLLANKCDQNKDSSQSPSQVDQFCKEHGFAGWFETSAKDNINIEEAARFLVEKILVNHQSFPNEENDVDKIKLDQETLRAENKSQCC

SEQ ID NO: 70715 - protein, 237 aa, Homo sapiens
  Payload ID: 14035
  Gene Symbol: RAB33A
  Gene Name: RAB33A, member RAS oncogene family
  Uniprot ID: Q14088
  ENSP ID: ENSP00000257017
MAQPILGHGSLQPASAAGLASLELDSSLDQYVQIRIFKIIVIGDSNVGKTCLTFRFCGGTFPDKTEATIGVDFREKTVEIEGEKIKVQVWDTAGQERFRKSMVEHYYRNVHAVVFVYDVTKMTSFTNLKMWIQECNGHAVPPLVPKVLVGNKCDLREQIQVPSNLALKFADAHNMLLFETSAKDPKESQNVESIFMCLACRLKAQKSLLYRDAERQQGKVQKLEFPQEANSKTSCPC

SEQ ID NO: 70716 - protein, 229 aa, Homo sapiens
  Payload ID: 14036
  Gene Symbol: RAB33B
  Gene Name: RAB33B, member RAS oncogene family
  Uniprot ID: Q9H082
  ENSP ID: ENSP00000306496
MAEEMESSLEASFSSSGAVSGASGFLPPARSRIFKIIVIGDSNVGKTCLTYRFCAGRFPDRTEATIGVDFRERAVEIDGERIKIQLWDTAGQERFRKSMVQHYYRNVHAVVFVYDMTNMASFHSLPSWIEECKQHLLANDIPRILVGNKCDLRSAIQVPTDLAQKFADTHSMPLFETSAKNPNDNDHVEAIFMTLAHKLKSHKPLMLSQPPDNGIILKPEPKPAMTCWC

SEQ ID NO: 70717 - protein, 210 aa, Homo sapiens
  Payload ID: 14037
  Gene Symbol: RAB34
  Gene Name: RAB34, member RAS oncogene family
  ENSP ID: ENSP00000226259
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFF

SEQ ID NO: 70718 - protein, 259 aa, Homo sapiens
  Payload ID: 14037
  Gene Symbol: RAB34
  Gene Name: RAB34, member RAS oncogene family
  Uniprot ID: Q9BZG1
  ENSP ID: ENSP00000301043
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 70719 - protein, 260 aa, Homo sapiens
  Payload ID: 14037
  Gene Symbol: RAB34
  Gene Name: RAB34, member RAS oncogene family
  ENSP ID: ENSP00000378663
MNILAPVRRDRVLAELPQCLRKEAALHGHKDFHPRVTCACQEHRTGTVGRFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 70720 - protein, 251 aa, Homo sapiens
  Payload ID: 14037
  Gene Symbol: RAB34
  Gene Name: RAB34, member RAS oncogene family
  Uniprot ID: Q9BZG1
  ENSP ID: ENSP00000378664
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTASKKKPTCCP

SEQ ID NO: 70721 - protein, 259 aa, Homo sapiens; identical to SEQ ID NO: 70718
  Payload ID: 14037
  Gene Symbol: RAB34
  Gene Name: RAB34, member RAS oncogene family
  Uniprot ID: Q9BZG1
  ENSP ID: ENSP00000378666

SEQ ID NO: 70722 - protein, 251 aa, Homo sapiens; identical to SEQ ID NO: 70720
  Payload ID: 14037
  Gene Symbol: RAB34
  Gene Name: RAB34, member RAS oncogene family
  Uniprot ID: Q9BZG1
  ENSP ID: ENSP00000391048

SEQ ID NO: 70723 - protein, 171 aa, Homo sapiens
  Payload ID: 14037
  Gene Symbol: RAB34
  Gene Name: RAB34, member RAS oncogene family
  ENSP ID: ENSP00000397499
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKFQEGSEYPCSVCADGERRPPGGPGDEG

SEQ ID NO: 70724 - protein, 210 aa, Homo sapiens; identical to SEQ ID NO: 70717
  Payload ID: 14037
  Gene Symbol: RAB34
  Gene Name: RAB34, member RAS oncogene family
  ENSP ID: ENSP00000398706

SEQ ID NO: 70725 - protein, 259 aa, Homo sapiens; identical to SEQ ID NO: 70718
  Payload ID: 14037
  Gene Symbol: RAB34
  Gene Name: RAB34, member RAS oncogene family
  Uniprot ID: Q9BZG1
  ENSP ID: ENSP00000404180

SEQ ID NO: 70726 - protein, 258 aa, Homo sapiens
  Payload ID: 14037
  Gene Symbol: RAB34
  Gene Name: RAB34, member RAS oncogene family
  ENSP ID: ENSP00000407953
MSHLPGLELRREAPPLLGPLLSPFPLPAGSWHRQMLRSSLRFPITNSAGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCC

SEQ ID NO: 70727 - protein, 237 aa, Homo sapiens
  Payload ID: 14037
  Gene Symbol: RAB34
  Gene Name: RAB34, member RAS oncogene family
  Uniprot ID: Q9BZG1
  ENSP ID: ENSP00000410279
MNILAPVRRDRVLAELPQCLRKEAALHGHKDFHPRVTCACQEHRTGTVGFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKPTCCP

SEQ ID NO: 70728 - protein, 268 aa, Homo sapiens
  Payload ID: 14037
  Gene Symbol: RAB34
  Gene Name: RAB34, member RAS oncogene family
  ENSP ID: ENSP00000413156
MSHLPGLELRREAPPLLGPLLSPFPLPAGSWHRQMLRSSLRFPITNSAGAPCKAAGRMNILAPVRRDRVLAELPQCLRKEAALHGHKDFHPRVTCACQEHRTGTVGRFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKTVQRLPSPRALCHPHSSRA

SEQ ID NO: 70729 - protein, 156 aa, Homo sapiens
  Payload ID: 14037
  Gene Symbol: RAB34
  Gene Name: RAB34, member RAS oncogene family
  ENSP ID: ENSP00000463488
  MOD_RES (1)..(1): Any amino acid
XMLRSSLRFPITNSAGLQLWDTAGQERFKCIASTYYRGAQAIIIVFNLNDVASLEHTKQWLADALKENDPSSVLLFLTPAQYALMEKDALQVAQEMKAEYWAVSSLTGENVREFFFRVAALTFEANVLAELEKSGARRIGDVVRINSDDSNLYLTA

SEQ ID NO: 70730 - protein, 149 aa, Homo sapiens
  Payload ID: 14037
  Gene Symbol: RAB34
  Gene Name: RAB34, member RAS oncogene family
  ENSP ID: ENSP00000464723
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLAD

SEQ ID NO: 70731 - protein, 51 aa, Homo sapiens
  Payload ID: 14037
  Gene Symbol: RAB34
  Gene Name: RAB34, member RAS oncogene family
  ENSP ID: ENSP00000465352
MNILAPVRRDRVLAELPQCLRKEAALHGHKDFHPRVTCACQEHRTGTVGRF

SEQ ID NO: 70732 - protein, 48 aa, Homo sapiens
  Payload ID: 14037
  Gene Symbol: RAB34
  Gene Name: RAB34, member RAS oncogene family
  ENSP ID: ENSP00000476427
MNILAPVRRDRVLAELPQCLRKEAALHGHKDFHPRVTCACQEHRTGTV

SEQ ID NO: 70733 - protein, 211 aa, Homo sapiens
  Payload ID: 14037
  Gene Symbol: RAB34
  Gene Name: RAB34, member RAS oncogene family
  ENSP ID: ENSP00000487160
MNILAPVRRDRVLAELPQCLRKEAALHGHKDFHPRVTCACQEHRTGTVGRFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKTVQRLPSPRALCHPHSSRA

SEQ ID NO: 70734 - protein, 201 aa, Homo sapiens
  Payload ID: 14038
  Gene Symbol: RAB35
  Gene Name: RAB35, member RAS oncogene family
  Uniprot ID: Q15286
  ENSP ID: ENSP00000229340
MARDYDHLFKLLIIGDSGVGKSSLLLRFADNTFSGSYITTIGVDFKIRTVEINGEKVKLQIWDTAGQERFRTITSTYYRGTHGVIVVYDVTSAESFVNVKRWLHEINQNCDDVCRILVGNKNDDPERKVVETEDAYKFAGQMGIQLFETSAKENVNVEEMFNCITELVLRAKKDNLAKQQQQQQNDVVKLTKNSKRKKRCC

SEQ ID NO: 70735 - protein, 152 aa, Homo sapiens
  Payload ID: 14038
  Gene Symbol: RAB35
  Gene Name: RAB35, member RAS oncogene family
  Uniprot ID: Q15286
  ENSP ID: ENSP00000441883
MARDYDHLFKLLIIGDSGVGKSSLLLRFADNTFSGSYITTIGVDFKIRTVEINGEKVKLQIWDTAGQERFRTITSTYYRGTHGVIVVYDVTSAESFVNVKRWLHEINQNCDDVCRILDVQLHHGAGPPSKERQPGKTAAATTERCGEAHEEQ

SEQ ID NO: 70736 - protein, 147 aa, Homo sapiens
  Payload ID: 14038
  Gene Symbol: RAB35
  Gene Name: RAB35, member RAS oncogene family
  ENSP ID: ENSP00000442555
MARDYDHLFKLLIIGDSGDLGAACLTQGRRKRSGIEWKRCSWCVAAQGGGKSIEKCGQEQFTVAFCRQHFLRQLHHHDRSGFQDPDRGDQRGEGEAADLGHSGAGALPHHHLHVLSGDPRGHCGLRRHQCRVLCQRQAVASRNQPEL

SEQ ID NO: 70737 - protein, 185 aa, Homo sapiens
  Payload ID: 14038
  Gene Symbol: RAB35
  Gene Name: RAB35, member RAS oncogene family
  ENSP ID: ENSP00000443994
MARDYDHLFKLLIIGDSGVGKSSLLLRFADNTFSGSYITTIGVDFKIRTVEINGEKVKLQIWDTAGQERFRTITSTAESFVNVKRWLHEINQNCDDVCRILVGNKNDDPERKVVETEDAYKFAGQMGIQLFETSAKENVNVEEMFNCITELVLRAKKDNLAKQQQQQQNDVVKLTKNSKRKKRCC

SEQ ID NO: 70738 - protein, 333 aa, Homo sapiens
  Payload ID: 14039
  Gene Symbol: RAB36
  Gene Name: RAB36, member RAS oncogene family
  Uniprot ID: O95755
  ENSP ID: ENSP00000263116
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGLKLSKVVVVGDLYVGKTSLIHRFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGNGDLIQMEGSPPETQESKRPSSLGCC

SEQ ID NO: 70739 - protein, 311 aa, Homo sapiens
  Payload ID: 14039
  Gene Symbol: RAB36
  Gene Name: RAB36, member RAS oncogene family
  Uniprot ID: O95755
  ENSP ID: ENSP00000343494
MVIAGASWMLGRAAASPTQTPPTTSTIRVARRSRVALVAMVIAAAGSGGPGRAEPQLSQPSLDCGRMRSSLTPLGPPVSRDRVIASFPKWYTPEACLQLREHFHGQVSAACQRRNTGTVGFCKNVFDRDYKATIGVDFEIERFEIAGIPYSLQIWDTAGQEKFKCIASAYYRGAQVIITAFDLTDVQTLEHTRQWLEDALRENEAGSCFIFLVGTKKDLLSGAACEQAEADAVHLAREMQAEYWSVSAKTGENVKAFFSRVAALAFEQSVLQDLERQSSARLQVGNGDLIQMEGSPPETQESKRPSSLGCC

SEQ ID NO: 70740 - protein, 132 aa, Homo sapiens
  Payload ID: 14039
  Gene Symbol: RAB36
  Gene Name: RAB36, member RAS oncogene family
  ENSP ID: ENSP00000397594
  MOD_RES (1)..(1): Any amino acid
XVSAACQRRNTGTVGLKLSKVVVVGDLYVGKTSLIHRFCKNVFDRDYKATIGVDFEIERFEIAGIPYSLQIWDTAGQEKFKCIASAYYRGAQGEQHATSGLNCMQQRGPCRAPQWESRVLCTGTSFLSSKTH

SEQ ID NO: 70741 - protein, 182 aa, Homo sapiens
  Payload ID: 14040
  Gene Symbol: RAB37
  Gene Name: RAB37, member RAS oncogene family
  ENSP ID: ENSP00000341354
MDLQRPDSYQGGAGPDFNDHVLHKTILVGDSGVGKTSLLVQFDQGKFIPGSFSATVGIGFTNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAK

SEQ ID NO: 70742 - protein, 189 aa, Homo sapiens
  Payload ID: 14040
  Gene Symbol: RAB37
  Gene Name: RAB37, member RAS oncogene family
  ENSP ID: ENSP00000376387
MTGTPGAVATRDGEAPERSPPCSPSYDLTGKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAK

SEQ ID NO: 70743 - protein, 186 aa, Homo sapiens
  Payload ID: 14040
  Gene Symbol: RAB37
  Gene Name: RAB37, member RAS oncogene family
  Uniprot ID: Q96AX2
  ENSP ID: ENSP00000376388
MTGTPGAVATRDGEAPERSPPCSPSYDLTGKNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 70744 - protein, 223 aa, Homo sapiens
  Payload ID: 14040
  Gene Symbol: RAB37
  Gene Name: RAB37, member RAS oncogene family
  Uniprot ID: Q96AX2
  ENSP ID: ENSP00000376389
MTGTPGAVATRDGEAPERSPPCSPSYDLTGKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 70745 - protein, 228 aa, Homo sapiens
  Payload ID: 14040
  Gene Symbol: RAB37
  Gene Name: RAB37, member RAS oncogene family
  Uniprot ID: Q96AX2
  ENSP ID: ENSP00000376390
MWLMSEAHGAEPVLLREAARPFTQTLRLCVPSGNSKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 70746 - protein, 191 aa, Homo sapiens
  Payload ID: 14040
  Gene Symbol: RAB37
  Gene Name: RAB37, member RAS oncogene family
  ENSP ID: ENSP00000376391
MWLMSEAHGAEPVLLREAARPFTQTLRLCVPSGNSKNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 70747 - protein, 216 aa, Homo sapiens
  Payload ID: 14040
  Gene Symbol: RAB37
  Gene Name: RAB37, member RAS oncogene family
  Uniprot ID: Q96AX2
  ENSP ID: ENSP00000383934
MDLQRPDSYQGGAGPDFNDHVLHKTILVGDSGVGKTSLLVQFDQGKFIPGSFSATVGIGFTNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 70748 - protein, 196 aa, Homo sapiens
  Payload ID: 14040
  Gene Symbol: RAB37
  Gene Name: RAB37, member RAS oncogene family
  ENSP ID: ENSP00000432086
MCCKVMLLGDTGVGKTCFLIQFKDGAFLSGTFIATVGIDFRNKVVTVDGVRVKLQIWDTAGQERFRSVTHAYYRDAQALLLLYDITNKSSFDNIRAWLTEIHEYAQRDVVIMLLGNKADMSSERVIRSEDGETLAREYGVPFLETSAKTGMNVELAFLAIAKELKYRAGHQADEPSFQIRDYVESQKKRSSCCSFM

SEQ ID NO: 70749 - protein, 223 aa, Homo sapiens; identical to SEQ ID NO: 70744
  Payload ID: 14040
  Gene Symbol: RAB37
  Gene Name: RAB37, member RAS oncogene family
  Uniprot ID: Q96AX2
  ENSP ID: ENSP00000436563

SEQ ID NO: 70750 - protein, 223 aa, Homo sapiens; identical to SEQ ID NO: 70744
  Payload ID: 14040
  Gene Symbol: RAB37
  Gene Name: RAB37, member RAS oncogene family
  Uniprot ID: Q96AX2
  ENSP ID: ENSP00000483155

SEQ ID NO: 70751 - protein, 211 aa, Homo sapiens
  Payload ID: 14041
  Gene Symbol: RAB38
  Gene Name: RAB38, member RAS oncogene family
  Uniprot ID: P57729
  ENSP ID: ENSP00000243662
MQAPHKEHLYKLLVIGDLGVGKTSIIKRYVHQNFSSHYRATIGVDFALKVLHWDPETVVRLQLWDIAGQERFGNMTRVYYREAMGAFIVFDVTRPATFEAVAKWKNDLDSKLSLPNGKPVSVVLLANKCDQGKDVLMNNGLKMDQFCKEHGFVGWFETSAKENINIDEASRCLVKHILANECDLMESIEPDVVKPHLTSTKVASCSGCAKS

SEQ ID NO: 70752 - protein, 210 aa, Homo sapiens
  Payload ID: 14041
  Gene Symbol: RAB38
  Gene Name: RAB38, member RAS oncogene family
  ENSP ID: ENSP00000433317
  MOD_RES (1)..(1): Any amino acid
XQAALPWSGTARLAGRQDAGPAQGAPVQVAGDWRPGRGEDQYHQALRAPELLFALPGHNRRGLRAQGQERFGNMTRVYYREAMGAFIVFDVTRPATFEAVAKWKNDLDSKLSLPNGKPVSVVLLANKCDQGKDVLMNNGLKMDQFCKEHGFVGWFETSAKENINIDEASRCLVKHILANECDLMESIEPDVVKPHLTSTKVASCSGCAKS

SEQ ID NO: 70753 - protein, 89 aa, Homo sapiens
  Payload ID: 14041
  Gene Symbol: RAB38
  Gene Name: RAB38, member RAS oncogene family
  ENSP ID: ENSP00000435340
  MOD_RES (1)..(1): Any amino acid
XRLRFPGQARHVWPAARMQAPHKEHLYKLLVIGDLGVGKTSIIKRYVHQNFSSHYRATIGVDFALKVLHWDPETVVRLQLWDIAGKYKH

SEQ ID NO: 70754 - protein, 217 aa, Homo sapiens
  Payload ID: 14042
  Gene Symbol: RAB39A
  Gene Name: RAB39A, member RAS oncogene family
  Uniprot ID: Q14964
  ENSP ID: ENSP00000322594
METIWIYQFRLIVIGDSTVGKSCLLHRFTQGRFPGLRSPACDPTVGVDFFSRLLEIEPGKRIKLQLWDTAGQERFRSITRSYYRNSVGGFLVFDITNRRSFEHVKDWLEEAKMYVQPFRIVFLLVGHKCDLASQRQVTREEAEKLSADCGMKYIETSAKDATNVEESFTILTRDIYELIKKGEICIQDGWEGVKSGFVPNTVHSSEEAVKPRKECFC

SEQ ID NO: 70755 - protein, 213 aa, Homo sapiens
  Payload ID: 14043
  Gene Symbol: RAB39B
  Gene Name: RAB39B, member RAS oncogene family
  Uniprot ID: Q96DA2
  ENSP ID: ENSP00000358466
MEAIWLYQFRLIVIGDSTVGKSCLIRRFTEGRFAQVSDPTVGVDFFSRLVEIEPGKRIKLQIWDTAGQERFRSITRAYYRNSVGGLLLFDITNRRSFQNVHEWLEETKVHVQPYQIVFVLVGHKCDLDTQRQVTRHEAEKLAAAYGMKYIETSARDAINVEKAFTDLTRDIYELVKRGEITIQEGWEGVKSGFVPNVVHSSEEVVKSERRCLC

SEQ ID NO: 70756 - protein, 460 aa, Homo sapiens
  Payload ID: 14044
  Gene Symbol: RAB3IP
  Gene Name: RAB3A interacting protein
  Uniprot ID: Q96QF0
  ENSP ID: ENSP00000247833
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 70757 - protein, 411 aa, Homo sapiens
  Payload ID: 14044
  Gene Symbol: RAB3IP
  Gene Name: RAB3A interacting protein
  Uniprot ID: Q96QF0
  ENSP ID: ENSP00000355381
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKSLLYVTFLHTFDTFSRDS

SEQ ID NO: 70758 - protein, 369 aa, Homo sapiens
  Payload ID: 14044
  Gene Symbol: RAB3IP
  Gene Name: RAB3A interacting protein
  ENSP ID: ENSP00000368086
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKIGFSCSGGCGKQYSKH

SEQ ID NO: 70759 - protein, 315 aa, Homo sapiens
  Payload ID: 14044
  Gene Symbol: RAB3IP
  Gene Name: RAB3A interacting protein
  Uniprot ID: Q96QF0
  ENSP ID: ENSP00000368092
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEVTHQGLSPLTLLILVSSHH

SEQ ID NO: 70760 - protein, 395 aa, Homo sapiens
  Payload ID: 14044
  Gene Symbol: RAB3IP
  Gene Name: RAB3A interacting protein
  Uniprot ID: Q96QF0
  ENSP ID: ENSP00000419216
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKSLLYVTFLHTFDTFSRDS

SEQ ID NO: 70761 - protein, 189 aa, Homo sapiens
  Payload ID: 14044
  Gene Symbol: RAB3IP
  Gene Name: RAB3A interacting protein
  ENSP ID: ENSP00000432634
  MOD_RES (1)..(1): Any amino acid
XNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRVSDLTMNFNKACFDMGHLTIHDIFSIWPRSLLYVTFLHTFDTFSRDS

SEQ ID NO: 70762 - protein, 304 aa, Homo sapiens
  Payload ID: 14044
  Gene Symbol: RAB3IP
  Gene Name: RAB3A interacting protein
  Uniprot ID: Q96QF0
  ENSP ID: ENSP00000436304
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEKMCSHWPE

SEQ ID NO: 70763 - protein, 476 aa, Homo sapiens
  Payload ID: 14044
  Gene Symbol: RAB3IP
  Gene Name: RAB3A interacting protein
  Uniprot ID: Q96QF0
  ENSP ID: ENSP00000447300
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 70764 - protein, 21 aa, Homo sapiens
  Payload ID: 14044
  Gene Symbol: RAB3IP
  Gene Name: RAB3A interacting protein
  ENSP ID: ENSP00000447499
  MOD_RES (1)..(1): Any amino acid
XGYLMMRLLLWLMIPWKASMK

SEQ ID NO: 70765 - protein, 254 aa, Homo sapiens
  Payload ID: 14044
  Gene Symbol: RAB3IP
  Gene Name: RAB3A interacting protein
  Uniprot ID: Q96QF0
  ENSP ID: ENSP00000448027
MVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 70766 - protein, 167 aa, Homo sapiens
  Payload ID: 14044
  Gene Symbol: RAB3IP
  Gene Name: RAB3A interacting protein
  ENSP ID: ENSP00000448102
MMLADLSLYNEFRLWKDEPTMDRTCPFLDKIYQEDIFPCLTFSKSELASAVLEAVENNTLSIEPVGLQPIRFVKASAVECGGPKKCALTGQSKSCKHRIKLGDSSNYYYISPFCRYRITSVCNFFTYIRYIQQGLVKQQDVDQMFWEVMQLRKEMSLAKLGYFKEEL

SEQ ID NO: 70767 - protein, 237 aa, Homo sapiens
  Payload ID: 14044
  Gene Symbol: RAB3IP
  Gene Name: RAB3A interacting protein
  ENSP ID: ENSP00000448218
  MOD_RES (1)..(1): Any amino acid
XYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEADLSLYNEFRLWKDEPTMDRTCPFLDKIYQEDIFPCLTFSKSEKMCSHWPE

SEQ ID NO: 70768 - protein, 91 aa, Homo sapiens
  Payload ID: 14044
  Gene Symbol: RAB3IP
  Gene Name: RAB3A interacting protein
  ENSP ID: ENSP00000448688
ITEACDGSDDIFGLSTDSLSRLRSPSVLEVREKGYERLKEELAKAQRELKLKDEECERLSKVRDQLGQELEELTASLFEVGLFTSWPTATS

SEQ ID NO: 70769 - protein, 254 aa, Homo sapiens; identical to SEQ ID NO: 70765
  Payload ID: 14044
  Gene Symbol: RAB3IP
  Gene Name: RAB3A interacting protein
  Uniprot ID: Q96QF0
  ENSP ID: ENSP00000448773

SEQ ID NO: 70770 - protein, 320 aa, Homo sapiens
  Payload ID: 14044
  Gene Symbol: RAB3IP
  Gene Name: RAB3A interacting protein
  Uniprot ID: Q96QF0
  ENSP ID: ENSP00000448944
MGLKKMKGLSYDEAFAMANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEELAKAQRELKLKDEECERLSKVRDQLGQELEELTASLFEEAHKMVREANIKQATAEKQLKEAQGKIDVLQAEVAALKTLVLSSSPTSPTQEPLPGGKTPFKKGHTRNKSTSSAMSGSHQDLSVIQPIVKDCKEKMCSHWPE

SEQ ID NO: 70771 - protein, 165 aa, Homo sapiens
  Payload ID: 14044
  Gene Symbol: RAB3IP
  Gene Name: RAB3A interacting protein
  ENSP ID: ENSP00000450355
MANDPLEGFHEVNLASPTSPDLLGVYESGTQEQTTSPSVIYRPHPSALSSVPIQANALDVSELPTQPVYSSPRRLNCAEISSISFHVTDPAPCSTSGVTAGLTKLTTRKDNYNAEREFLQGATITEACDGSDDIFGLSTDSLSRLRSPSVLEVREKGYERLKEEL

SEQ ID NO: 70772 - protein, 356 aa, Homo sapiens
  Payload ID: 14045
  Gene Symbol: RAB3IL1
  Gene Name: RAB3A interacting protein (rabin3)-like 1
  Uniprot ID: Q8TBN0
  ENSP ID: ENSP00000301773
MDSSEEHAGCPARGTCPVFLAMSAGTVRYAPSGLCPVLEGNLREEPWGTDSPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 70773 - protein, 382 aa, Homo sapiens
  Payload ID: 14045
  Gene Symbol: RAB3IL1
  Gene Name: RAB3A interacting protein (rabin3)-like 1
  Uniprot ID: Q8TBN0
  ENSP ID: ENSP00000378313
MWSGPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDREGKEVDTILFAEFQAWRESPTLDKTCPFLERVYREDVGPCLDFTMQELSVLVRAAVEDNTLTIEPVASQTLPTVKVAEVDCSSTNTCALSGLTRTCRHRIRLGDSKSHYYISPSSRARITAVCNFFTYIRYIQQGLVRQDAEPMFWEIMRLRKEMSLAKLGFFPQEA

SEQ ID NO: 70774 - protein, 65 aa, Homo sapiens
  Payload ID: 14045
  Gene Symbol: RAB3IL1
  Gene Name: RAB3A interacting protein (rabin3)-like 1
  ENSP ID: ENSP00000432745
QQGLVRQDAHSARPGSPLLHQPLLAAESSPEPVWPDPLTEPMFWEIMRLRKEMSLAKLGFFPQEA

SEQ ID NO: 70775 - protein, 263 aa, Homo sapiens
  Payload ID: 14045
  Gene Symbol: RAB3IL1
  Gene Name: RAB3A interacting protein (rabin3)-like 1
  ENSP ID: ENSP00000435444
MDSSEEHAGCPARGTCPVFLAMSAGTVRYAPSGLCPVLEGNLREEPWGTDSPPQPDQGLPPPLAAVPVPWKSTDPCQGHRESPGALVETSAGEEAQGQEGPAAAQLDVLRLRSSSMEIREKGSEFLKEELHRAQKELKLKDEECERLSKVREQLEQELEELTASLFEEAHKMVREANMKQAASEKQLKEARGKIDMLQAEVTALKTLVITSTPASPNRELHPQLLSPTKAGPRKGHSRHKSTSSTLCPAVCPAAGHTLTPDRE

SEQ ID NO: 70776 - protein, 220 aa, Homo sapiens
  Payload ID: 14046
  Gene Symbol: RAB3A
  Gene Name: RAB3A, member RAS oncogene family
  Uniprot ID: P20336
  ENSP ID: ENSP00000222256
MASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 70777 - protein, 115 aa, Homo sapiens
  Payload ID: 14046
  Gene Symbol: RAB3A
  Gene Name: RAB3A, member RAS oncogene family
  ENSP ID: ENSP00000472335
MASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQD

SEQ ID NO: 70778 - protein, 125 aa, Homo sapiens
  Payload ID: 14046
  Gene Symbol: RAB3A
  Gene Name: RAB3A, member RAS oncogene family
  ENSP ID: ENSP00000474603
MGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 70779 - protein, 219 aa, Homo sapiens
  Payload ID: 14047
  Gene Symbol: RAB3B
  Gene Name: RAB3B, member RAS oncogene family
  Uniprot ID: P20337
  ENSP ID: ENSP00000360718
MASVTDGKTGVKDASDQNFDYMFKLLIIGNSSVGKTSFLFRYADDTFTPAFVSTVGIDFKVKTVYRHEKRVKLQIWDTAGQERYRTITTAYYRGAMGFILMYDITNEESFNAVQDWATQIKTYSWDNAQVILVGNKCDMEEERVVPTEKGQLLAEQLGFDFFEASAKENISVRQAFERLVDAICDKMSDSLDTDPSMLGSSKNTRLSDTPPLLQQNCSC

SEQ ID NO: 70780 - protein, 227 aa, Homo sapiens
  Payload ID: 14048
  Gene Symbol: RAB3C
  Gene Name: RAB3C, member RAS oncogene family
  Uniprot ID: Q96E17
  ENSP ID: ENSP00000282878
MRHEAPMQMASAQDARYGQKDSSDQNFDYMFKLLIIGNSSVGKTSFLFRYADDSFTSAFVSTVGIDFKVKTVFKNEKRIKLQIWDTAGQERYRTITTAYYRGAMGFILMYDITNEESFNAVQDWSTQIKTYSWDNAQVILVGNKCDMEDERVISTERGQHLGEQLGFEFFETSAKDNINVKQTFERLVDIICDKMSESLETDPAITAAKQNTRLKETPPPPQPNCAC

SEQ ID NO: 70781 - protein, 219 aa, Homo sapiens
  Payload ID: 14049
  Gene Symbol: RAB3D
  Gene Name: RAB3D, member RAS oncogene family
  Uniprot ID: O95716
  ENSP ID: ENSP00000222120
MASAGDTQAGPRDAADQNFDYMFKLLLIGNSSVGKTSFLFRYADDSFTPAFVSTVGIDFKVKTVYRHDKRIKLQIWDTAGQERYRTITTAYYRGAMGFLLMYDIANQESFAAVQDWATQIKTYSWDNAQVILVGNKCDLEDERVVPAEDGRRLADDLGFEFFEASAKENINVKQVFERLVDVICEKMNESLEPSSSSGSNGKGPAVGDAPAPQPSSCSC

SEQ ID NO: 70782 - protein, 219 aa, Homo sapiens; identical to SEQ ID NO: 70781
  Payload ID: 14049
  Gene Symbol: RAB3D
  Gene Name: RAB3D, member RAS oncogene family
  Uniprot ID: O95716
  ENSP ID: ENSP00000466000

SEQ ID NO: 70783 - protein, 277 aa, Homo sapiens
  Payload ID: 14050
  Gene Symbol: RAB40A
  Gene Name: RAB40A, member RAS oncogene family
  Uniprot ID: Q8WXH6
  ENSP ID: ENSP00000305648
MSAPGSPDQAYDFLLKFLLVGDRDVGKSEILESLQDGAAESPYSHLGGIDYKTTTILLDGQRVKLKLWDTSGQGRFCTIFRSYSRGAQGVILVYDIANRWSFEGMDRWIKKIEEHAPGVPKILVGNRLHLAFKRQVPREQAQAYAERLGVTFFEVSPLCNFNIIESFTELARIVLLRHRMNWLGRPSKVLSLQDLCCRTIVSCTPVHLVDKLPLPSTLRSHLKSFSMAKGLNARMMRGLSYSLTTSSTHKSSLCKVEIVCPPQSPPKNCTRNSCKIS

SEQ ID NO: 70784 - protein, 277 aa, Homo sapiens; identical to SEQ ID NO: 70783
  Payload ID: 14050
  Gene Symbol: RAB40A
  Gene Name: RAB40A, member RAS oncogene family
  Uniprot ID: Q8WXH6
  ENSP ID: ENSP00000361716

SEQ ID NO: 70785 - protein, 278 aa, Homo sapiens
  Payload ID: 14051
  Gene Symbol: RAB40AL
  Gene Name: RAB40A, member RAS oncogene family-like
  Uniprot ID: P0C0E4
  ENSP ID: ENSP00000218249
MSAPGSPDQAYDFLLKFLLVGDRDVGKSEILESLQDGTAESPYSHLGGIDYKTTTILLDGQRVKLKLWDTSGQGRFCTIFRSYSRGAQGVILVYDIANRWSFEGMDRWIKKIEEHAPGVPKILVGNRLHLAFKRQVPREQAQAYAERLGVTFFEVSPLCNFNIIESFTELARIVLLRHRLNWLGRPSKVLSLQDLCCRTIVSCTPVHLVDKLPLPIALRSHLKSFSMAKGLNARMMRGLSYSLTTSSTHKRSSLCKVKIVCPPQSPPKNCTRNSCKIS

SEQ ID NO: 70786 - protein, 99 aa, Homo sapiens
  Payload ID: 14052
  Gene Symbol: RAB40B
  Gene Name: RAB40B, member RAS oncogene family
  ENSP ID: ENSP00000269347
MDRLWRPSKVLSLQDLCCRAVVSCTPVHLVDKLPLPIALRSHLKSFSMANGLNARMMHGGSYSLTTSSTHKRSSLRKVKLVRPPQSPPKNCTRNSCKIS

SEQ ID NO: 70787 - protein, 139 aa, Homo sapiens
  Payload ID: 14052
  Gene Symbol: RAB40B
  Gene Name: RAB40B, member RAS oncogene family
  ENSP ID: ENSP00000438897
MSALGSPVRAYDFLLKFLLVGDSDVGKGEILASLQDGAAESPYGHPAGIDYKTTTILLDGRRVKLQLWDTSGQGRFCTIFRSYSRGAQGVILVYDIANRWSFDGIDRWIKEIDESRSRSWPGSCCCGMGWTGSGGRARC

SEQ ID NO: 70788 - protein, 42 aa, Homo sapiens
  Payload ID: 14052
  Gene Symbol: RAB40B
  Gene Name: RAB40B, member RAS oncogene family
  ENSP ID: ENSP00000458638
GRFCTIFRSYSRGAQGVILVYDIANRWSFDGIDRWIKEIDEC

SEQ ID NO: 70789 - protein, 278 aa, Homo sapiens
  Payload ID: 14052
  Gene Symbol: RAB40B
  Gene Name: RAB40B, member RAS oncogene family
  Uniprot ID: Q12829
  ENSP ID: ENSP00000461785
MSALGSPVRAYDFLLKFLLVGDSDVGKGEILASLQDGAAESPYGHPAGIDYKTTTILLDGRRVKLQLWDTSGQGRFCTIFRSYSRGAQGVILVYDIANRWSFDGIDRWIKEIDEHAPGVPKILVGNRLHLAFKRQVPTEQAQAYAERLGVTFFEVSPLCNFNITESFTELARIVLLRHGMDRLWRPSKVLSLQDLCCRAVVSCTPVHLVDKLPLPIALRSHLKSFSMANGLNARMMHGGSYSLTTSSTHKRSSLRKVKLVRPPQSPPKNCTRNSCKIS

SEQ ID NO: 70790 - protein, 281 aa, Homo sapiens
  Payload ID: 14053
  Gene Symbol: RAB40C
  Gene Name: RAB40C, member RAS oncogene family
  Uniprot ID: Q96S21
  ENSP ID: ENSP00000248139
MGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSPPQNCSRSNCKIS

SEQ ID NO: 70791 - protein, 281 aa, Homo sapiens; identical to SEQ ID NO: 70790
  Payload ID: 14053
  Gene Symbol: RAB40C
  Gene Name: RAB40C, member RAS oncogene family
  Uniprot ID: Q96S21
  ENSP ID: ENSP00000438382

SEQ ID NO: 70792 - protein, 281 aa, Homo sapiens; identical to SEQ ID NO: 70790
  Payload ID: 14053
  Gene Symbol: RAB40C
  Gene Name: RAB40C, member RAS oncogene family
  Uniprot ID: Q96S21
  ENSP ID: ENSP00000438492

SEQ ID NO: 70793 - protein, 281 aa, Homo sapiens; identical to SEQ ID NO: 70790
  Payload ID: 14053
  Gene Symbol: RAB40C
  Gene Name: RAB40C, member RAS oncogene family
  Uniprot ID: Q96S21
  ENSP ID: ENSP00000445050

SEQ ID NO: 70794 - protein, 156 aa, Homo sapiens
  Payload ID: 14053
  Gene Symbol: RAB40C
  Gene Name: RAB40C, member RAS oncogene family
  ENSP ID: ENSP00000454347
MGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVS

SEQ ID NO: 70795 - protein, 38 aa, Homo sapiens
  Payload ID: 14053
  Gene Symbol: RAB40C
  Gene Name: RAB40C, member RAS oncogene family
  ENSP ID: ENSP00000454383
MTFFEVSPLCNFNVIESFTELSRIVLMRHGMEKIWRPN

SEQ ID NO: 70796 - protein, 213 aa, Homo sapiens
  Payload ID: 14053
  Gene Symbol: RAB40C
  Gene Name: RAB40C, member RAS oncogene family
  ENSP ID: ENSP00000455029
MGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNRVFSLQDLCCRAIVSCTPVHLIDKLP

SEQ ID NO: 70797 - protein, 237 aa, Homo sapiens
  Payload ID: 14053
  Gene Symbol: RAB40C
  Gene Name: RAB40C, member RAS oncogene family
  ENSP ID: ENSP00000455225
  MOD_RES (1)..(1): Any amino acid
XLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDERQVPTEQARAYAEKNCMTFFEVSPLCNFNVIESFTELSRIVLMRHGMEKIWRPNRVFSLQDLCCRAIVSCTPVHLIDKLPLPVTIKSHLKSFSMANGMNAVMMHGRSYSLASGAGGGGSKGNSLKRSKSIRPPQSP

SEQ ID NO: 70798 - protein, 49 aa, Homo sapiens
  Payload ID: 14053
  Gene Symbol: RAB40C
  Gene Name: RAB40C, member RAS oncogene family
  ENSP ID: ENSP00000455232
  MOD_RES (1)..(1): Any amino acid
XSQGSPVKSYDYLLKFLLVGDSDVGKGEILESLQDGAAESPYAYSNDCS

SEQ ID NO: 70799 - protein, 188 aa, Homo sapiens
  Payload ID: 14053
  Gene Symbol: RAB40C
  Gene Name: RAB40C, member RAS oncogene family
  ENSP ID: ENSP00000457116
MGSQGSPVKSYDYLLKFLLVGDSDVGKGEILESLQDGAAESPYAYSNGIDYKTTTILLDGRRVKLELWDTSGQGRFCTIFRSYSRGAQGILLVYDITNRWSFDGIDRWIKEIDEHAPGVPRILVGNRLHLAFKRQVPTEQARAYAEKNCMTFFEVSPLCNFNVIESFTELSRIVLMRHGMEKIWRPNR

SEQ ID NO: 70800 - protein, 130 aa, Homo sapiens
  Payload ID: 14053
  Gene Symbol: RAB40C
  Gene Name: RAB40C, member RAS oncogene family
  ENSP ID: ENSP00000457845
MGSQGSPVKSYDYLLKFLLVGDSDVGKGEILESLQDGAAESPYAYSNGIDYKTTTILLDGRRVKLELWDTSGQGRFCTIFRSYSRGAQLCPRYSRGDSLMDWPRGHLASTAARPPAARTPHLPAQETSTG

SEQ ID NO: 70801 - protein, 221 aa, Homo sapiens
  Payload ID: 14054
  Gene Symbol: RAB41
  Gene Name: RAB41, member RAS oncogene family
  Uniprot ID: Q5JT25
  ENSP ID: ENSP00000276066
MSAFGHDEAWMEAGGFGLEAAERTEYQSLCKSKLLFLGEQSGKTSIISRFMYNSFGCACQATVGIDFLSKTMYLEDQIVQLQLWDTAGQERFHSLIPSYIRDSTIAVVVYDITNINSFKETDKWVEHVRAERGDDVVIMLLGNKIDLDNKRQVTAEQGEEKSRNLNVMFIETSAKTGYNVKKLFRRVASALLSTRTSPPPKEGTVEIELESFEESGNRSYC

SEQ ID NO: 70802 - protein, 222 aa, Homo sapiens
  Payload ID: 14054
  Gene Symbol: RAB41
  Gene Name: RAB41, member RAS oncogene family
  Uniprot ID: Q5JT25
  ENSP ID: ENSP00000363597
MSAFGHDEAWMEAGGFGLEAAERTEYQSLCKSKLLFLGEQSVGKTSIISRFMYNSFGCACQATVGIDFLSKTMYLEDQIVQLQLWDTAGQERFHSLIPSYIRDSTIAVVVYDITNINSFKETDKWVEHVRAERGDDVVIMLLGNKIDLDNKRQVTAEQGEEKSRNLNVMFIETSAKTGYNVKKLFRRVASALLSTRTSPPPKEGTVEIELESFEESGNRSYC

SEQ ID NO: 70803 - protein, 34 aa, Homo sapiens
  Payload ID: 14054
  Gene Symbol: RAB41
  Gene Name: RAB41, member RAS oncogene family
  ENSP ID: ENSP00000421643
MYNSFGCACQATVGIDFLSKTMYLEDQIVQLQLW

SEQ ID NO: 70804 - protein, 105 aa, Homo sapiens
  Payload ID: 14055
  Gene Symbol: RAB42
  Gene Name: RAB42, member RAS oncogene family
  Uniprot ID: Q8N4Z0
  ENSP ID: ENSP00000362932
MATQGPDKVIFLLVGHKSDLQSTRCVSAQEAEELAASLGMAFVETSVKNNCNVDLAFDTLADAIQQALQQGDIKLEEGWGGVRLIHKTQIPRSPSRKQHSGPCQC

SEQ ID NO: 70805 - protein, 212 aa, Homo sapiens
  Payload ID: 14056
  Gene Symbol: RAB43
  Gene Name: RAB43, member RAS oncogene family
  Uniprot ID: Q86YS6
  ENSP ID: ENSP00000319781
MAGPGPGPGDPDEQYDFLFKLVLVGDASVGKTCVVQRFKTGAFSERQGSTIGVDFTMKTLEIQGKRVKLQIWDTAGQERFRTITQSYYRSANGAILAYDITKRSSFLSVPHWIEDVRKYAGSNIVQLLIGNKSDLSELREVSLAEAQSLAEHYDILCAIETSAKDSSNVEEAFLRVATELIMRHGGPLFSEKSPDHIQLNSKDIGEGWGCGC

SEQ ID NO: 70806 - protein, 212 aa, Homo sapiens; identical to SEQ ID NO: 70805
  Payload ID: 14056
  Gene Symbol: RAB43
  Gene Name: RAB43, member RAS oncogene family
  Uniprot ID: Q86YS6
  ENSP ID: ENSP00000376981

SEQ ID NO: 70807 - protein, 212 aa, Homo sapiens; identical to SEQ ID NO: 70805
  Payload ID: 14056
  Gene Symbol: RAB43
  Gene Name: RAB43, member RAS oncogene family
  Uniprot ID: Q86YS6
  ENSP ID: ENSP00000376982

SEQ ID NO: 70808 - protein, 212 aa, Homo sapiens; identical to SEQ ID NO: 70805
  Payload ID: 14056
  Gene Symbol: RAB43
  Gene Name: RAB43, member RAS oncogene family
  Uniprot ID: Q86YS6
  ENSP ID: ENSP00000376984

SEQ ID NO: 70809 - protein, 212 aa, Homo sapiens; identical to SEQ ID NO: 70805
  Payload ID: 14056
  Gene Symbol: RAB43
  Gene Name: RAB43, member RAS oncogene family
  Uniprot ID: Q86YS6
  ENSP ID: ENSP00000376985

SEQ ID NO: 70810 - protein, 86 aa, Homo sapiens
  Payload ID: 14056
  Gene Symbol: RAB43
  Gene Name: RAB43, member RAS oncogene family
  ENSP ID: ENSP00000390782
MAGPGPGPGDPDEQYDFLFKLVLVGDASVGKTCVVQRFKTGAFSERQGSTIGVDFTMKTLEIQGKRVKLQIWDTAGQERFRTITQS

SEQ ID NO: 70811 - protein, 155 aa, Homo sapiens
  Payload ID: 14056
  Gene Symbol: RAB43
  Gene Name: RAB43, member RAS oncogene family
  Uniprot ID: Q86YS6
  ENSP ID: ENSP00000427632
MAGPGPGPGDPDEQYDFLFKLVLVGDASVGKTCVVQRFKTGAFSERQGSTIGVDFTMKTLEIQGKRVKLQIWDTAGQERFRTITQSYYRSANGAILAYDITKRSSFLSVPHWIEDVRKYAGSNIVQLLIEMQSCYVAQADLELLASSNPPASTSK

SEQ ID NO: 70812 - protein, 155 aa, Homo sapiens; identical to SEQ ID NO: 70811
  Payload ID: 14056
  Gene Symbol: RAB43
  Gene Name: RAB43, member RAS oncogene family
  Uniprot ID: Q86YS6
  ENSP ID: ENSP00000481399

SEQ ID NO: 70813 - protein, 920 aa, Homo sapiens
  Payload ID: 14057
  Gene Symbol: RAB44
  Gene Name: RAB44, member RAS oncogene family
  Uniprot ID: Q7Z6P3
  ENSP ID: ENSP00000229824
  MOD_RES (1)..(1): Any amino acid
XFCPTENIFGSSQSPHRLRRRKPLPSKRVSATTSFPALEEADAEEKEAFLAFMEQLGTGHLLPKQMEIWQLWGQLRQEEPQLAGNLAGFLAKMTSRLQEAQADKEALELTLRKRDSDHHREVQQLYEEMEQQIRQEKQQLQAESDSRGLALTSQMQDVLEAKEREVQRLAEGQRELEAQLSHLRSTHQEAASENQQLQEAKRDLAGRLEEVRGQLQVTRGRLDAARGRVSWQVEEKLSFPGAGEKTPDPQAASPEEAPLPGLFGDNDDWDQLLSNFGSPPHGALQLCWSPPPTPRATSGPQTPRVVRQISISEPQAFLFGQEPSSDPDGAPRTPPGVTFSAKDNKGVDPHEQDIRAEQPVEPHDPDPNQEPGSTPEGRLLWGLSGSLVAPAFKVLIPLEDGPPPPANSPPPQAPAGSSKQIQASDPDDKGPGSWAPPSGAQPGAGAGPQEPTQTPPTMTERETQPGPSPTTALTGVGPAKPPRQRDALQQDLHATGSEPRLGTQRARALTLGPAEPFQGLEFVGPVPTERLEQGQAGPAVQEGLPEGLREAHGQVLGLGELSAFPHQELEEEPRSEEGKQEGRGGQDLSSEQSEQSVEAHGLETAHSELPQQDSLLVSLPSATPQAQVEAEGPTPGKSAPPRGSPPRGAQPGAGAGPQEPTQTPPTMAEQEAQPRPSLTTAHAEEQGPPHSREPRAESRLEDPGMDSREAGLTPSPGDPMAGGGPQANPDYLFHVIFLGDSNVGKTSFLHLLHQNSFATGLTATVGVDFRVKTLLVDNKCFVLQLWDTAGQERYHSMTRQLLRKADGVVLMYDITSQESFAHVRYWLDCLQDAGSDGVVILLLGNKMDCEEERQVSVEAGQQLAQELGVYFGECSAALGHNILEPVVNLARSLRMQEEGLKDSLVKVAPKRPPKRFGCCS

SEQ ID NO: 70814 - protein, 1021 aa, Homo sapiens
  Payload ID: 14057
  Gene Symbol: RAB44
  Gene Name: RAB44, member RAS oncogene family
  ENSP ID: ENSP00000481054
METGQRTSRKVRKLGSNRRRQTREPADGEGAAVAPEPESWSSQAAAELQAFFQDCGAKERGFVTREDLAVAKFSFLGSKEESEMIFDWVDVERKGHLSLEEFSSGLKNIFGSSQSPHRLRRRKPLPSKRVSATTSFPALEEADAEEKEAFLAFMEQLGTGHLLPKQMEIWQLWGQLRQEEPQLAGNLAGFLAKMTSRLQEAQADKEALELTLRKRDSDHHREVQQLYEEMEQQIRQEKQQLQAESDSRGLALTSQMQDVLEAKEREVQRLAEGQRELEAQLSHLRSTHQEAASENQQLQEAKRDLAGRLEEVRGQLQVTRGRLDAARGRVSWQVEEKLSFPGAGEKTPDPQAASPEEAPLPGLFGDNDDWDQLLSNFGSPPHGALQLCWSPPPTPRATSGPQTPRVVRQISISEPQAFLFGQEPSSDPDGAPRTPPGVTFSAKDNKGVDPHEQDIRAEQPVEPHDPDPNQEPGSTPEGRLLWGLSGSLVAPAFKVLIPLEDGPPPPANSPPPQAPAGSSKQIQASDPDDKGPGSWAPPSGAQPGAGAGPQEPTQTPPTMTERETQPGPSPTTALTGVGPAKPPRQRDALQQDLHATGSEPRLGTQRARALTLGPAEPFQGLEFVGPVPTERLEQGQAGPAVQEGLPEGLREAHGQVLGLGELSAFPHQELEEEPRSEEGKQEGRGGQDLSSEQSEQSVEAHGLETAHSELPQQDSLLVSLPSATPQAQVEAEGPTPGKSAPPRGSPPRGAQPGAGAGPQEPTQTPPTMAEQEAQPRPSLTTAHAEEQGPPHSREPRAESRLEDPGMDSREAGLTPSPGDPMAGGGPQANPDYLFHVIFLGDSNVGKTSFLHLLHQNSFATGLTATVGVDFRVKTLLVDNKCFVLQLWDTAGQERYHSMTRQLLRKADGVVLMYDITSQESFAHVRYWLDCLQDAGSDGVVILLLGNKMDCEEERQVSVEAGQQLAQELGVYFGECSAALGHNILEPVVNLARSLRMQEEGLKDSLVKVAPKRPPKRFGCCS

SEQ ID NO: 70815 - protein, 218 aa, Homo sapiens
  Payload ID: 14058
  Gene Symbol: RAB4A
  Gene Name: RAB4A, member RAS oncogene family
  Uniprot ID: P20338
  ENSP ID: ENSP00000355651
MSQTAMSETYDFLFKFLVIGNAGTGKSCLLHQFIEKKFKDDSNHTIGVEFGSKIINVGGKYVKLQIWDTAGQERFRSVTRSYYRGAAGALLVYDITSRETYNALTNWLTDARMLASQNIVIILCGNKKDLDADREVTFLEASRFAQENELMFLETSALTGENVEEAFVQCARKILNKIESGELDPERMGSGIQYGDAALRQLRSPRRAQAPNAQECGC

SEQ ID NO: 70816 - protein, 113 aa, Homo sapiens
  Payload ID: 14058
  Gene Symbol: RAB4A
  Gene Name: RAB4A, member RAS oncogene family
  ENSP ID: ENSP00000482077
MISPDARMLASQNIVIILCGNKKDLDADREVTFLEASRFAQENELMFLETSALTGENVEEAFVQCARKILNKIESGELDPERMGSGIQYGDAALRQLRSPRRAQAPNAQECGC

SEQ ID NO: 70817 - protein, 213 aa, Homo sapiens
  Payload ID: 14059
  Gene Symbol: RAB4B
  Gene Name: RAB4B, member RAS oncogene family
  Uniprot ID: P61018
  ENSP ID: ENSP00000349560
MAETYDFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCARTILNKIDSGELDPERMGSGIQYGDASLRQLRQPRSAQAVAPQPCGC

SEQ ID NO: 70818 - protein, 121 aa, Homo sapiens
  Payload ID: 14059
  Gene Symbol: RAB4B
  Gene Name: RAB4B, member RAS oncogene family
  ENSP ID: ENSP00000367557
MAETYDFLFKFLVIGSAGTGKSCLLHQFIENKFKQDSNHTIGVEFGSRVVNVGGKTVKLQIWDTAGQERFRSVTRSYYRGAAGALLVYDITRADVPGDQRSHRRERGGGVPQVCPHYPQQD

SEQ ID NO: 70819 - protein, 213 aa, Homo sapiens; identical to SEQ ID NO: 70817
  Payload ID: 14059
  Gene Symbol: RAB4B
  Gene Name: RAB4B, member RAS oncogene family
  Uniprot ID: P61018
  ENSP ID: ENSP00000470246

SEQ ID NO: 70820 - protein, 192 aa, Homo sapiens
  Payload ID: 14059
  Gene Symbol: RAB4B
  Gene Name: RAB4B, member RAS oncogene family
  ENSP ID: ENSP00000471504
  MOD_RES (1)..(1): Any amino acid
XAETYDFLFKFLVIGSAGTGKSCLLHQFIENKFKQDSNHTIGVEFGSRVVNVGGKTVKLQIWDTAGQERFRRETYNSLAAWLTDARTLASPNIVVILCGNKKDLDPEREVTFLEASRFAQENELMFLETSALTGENVEEAFLKCARTILNKIDSGELDPERMGSGIQYGDASLRQLRQPRSAQAVAPQPCGC

SEQ ID NO: 70821 - protein, 213 aa, Homo sapiens; identical to SEQ ID NO: 70817
  Payload ID: 14060
  Gene Symbol: RAB4B-EGLN2
  Gene Name: RAB4B-EGLN2 readthrough (NMD candidate)
  ENSP ID: ENSP00000469872

SEQ ID NO: 70822 - protein, 215 aa, Homo sapiens
  Payload ID: 14061
  Gene Symbol: RAB5A
  Gene Name: RAB5A, member RAS oncogene family
  Uniprot ID: P20339
  ENSP ID: ENSP00000273047
MASRGATRPNGPNTGNKICQFKLVLLGESAVGKSSLVLRFVKGQFHEFQESTIGAAFLTQTVCLDDTTVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTRNQCCSN

SEQ ID NO: 70823 - protein, 65 aa, Homo sapiens
  Payload ID: 14061
  Gene Symbol: RAB5A
  Gene Name: RAB5A, member RAS oncogene family
  ENSP ID: ENSP00000396632
MASRGATRPNGPNTGNKICQFKLVLLGESAVGKSSLVLRFVKGQFHEFQESTIGVTLEVIKAVSL

SEQ ID NO: 70824 - protein, 15 aa, Homo sapiens
  Payload ID: 14061
  Gene Symbol: RAB5A
  Gene Name: RAB5A, member RAS oncogene family
  ENSP ID: ENSP00000398450
MASRGATRPNGPNTG

SEQ ID NO: 70825 - protein, 62 aa, Homo sapiens
  Payload ID: 14061
  Gene Symbol: RAB5A
  Gene Name: RAB5A, member RAS oncogene family
  ENSP ID: ENSP00000403533
MASRGATRPNGPNTGNKICQFKLVLLGESAVGKSSLVLRFVKGQFHEFQESTIGVLFFQLLF

SEQ ID NO: 70826 - protein, 201 aa, Homo sapiens
  Payload ID: 14061
  Gene Symbol: RAB5A
  Gene Name: RAB5A, member RAS oncogene family
  Uniprot ID: P20339
  ENSP ID: ENSP00000411941
MASRGATRPNGPNTGNKICQFKLVLLGESAVGKSSLVLRFVKGQFHEFQESTIGVKFEIWDTAGQERYHSLAPMYYRGAQAAIVVYDITNEESFARAKNWVKELQRQASPNIVIALSGNKADLANKRAVDFQEAQSYADDNSLLFMETSAKTSMNVNEIFMAIAKKLPKNEPQNPGANSARGRGVDLTEPTQPTRNQCCSN

SEQ ID NO: 70827 - protein, 215 aa, Homo sapiens
  Payload ID: 14062
  Gene Symbol: RAB5B
  Gene Name: RAB5B, member RAS oncogene family
  Uniprot ID: P61020
  ENSP ID: ENSP00000353444
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQETFARAKTWVKELQRQASPSIVIALAGNKADLANKRMVEYEEAQAYADDNSLLFMETSAKTAMNVNDLFLAIAKKLPKSEPQNLGGAAGRSRGVDLHEQSQQNKSQCCSN

SEQ ID NO: 70828 - protein, 174 aa, Homo sapiens
  Payload ID: 14062
  Gene Symbol: RAB5B
  Gene Name: RAB5B, member RAS oncogene family
  Uniprot ID: P61020
  ENSP ID: ENSP00000391319
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQEAQAYADDNSLLFMETSAKTAMNVNDLFLAIAKKLPKSEPQNLGGAAGRSRGVDLHEQSQQNKSQCCSN

SEQ ID NO: 70829 - protein, 115 aa, Homo sapiens
  Payload ID: 14062
  Gene Symbol: RAB5B
  Gene Name: RAB5B, member RAS oncogene family
  ENSP ID: ENSP00000447895
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVYDITNQETFARAKTWV

SEQ ID NO: 70830 - protein, 100 aa, Homo sapiens
  Payload ID: 14062
  Gene Symbol: RAB5B
  Gene Name: RAB5B, member RAS oncogene family
  ENSP ID: ENSP00000449554
MTSRSTARPNGQPQASKICQFKLVLLGESAVGKSSLVLRFVKGQFHEYQESTIGAAFLTQSVCLDDTTVKFEIWDTAGQERYHSLAPMYYRGAQAAIVVY

SEQ ID NO: 70831 - protein, 79 aa, Homo sapiens
  Payload ID: 14062
  Gene Symbol: RAB5B
  Gene Name: RAB5B, member RAS oncogene family
  ENSP ID: ENSP00000449762
MSLEGVLKPGNPLPFPLPPLQYPPPSTLSHSDNLAMTSRSTARPNGQPQASKICQFKLVLLGESAVGKSSLVLRFVKGQ

SEQ ID NO: 70832 - protein, 215 aa, Homo sapiens; identical to SEQ ID NO: 70827
  Payload ID: 14062
  Gene Symbol: RAB5B
  Gene Name: RAB5B, member RAS oncogene family
  Uniprot ID: P61020
  ENSP ID: ENSP00000450168

SEQ ID NO: 70833 - protein, 73 aa, Homo sapiens
  Payload ID: 14062
  Gene Symbol: RAB5B
  Gene Name: RAB5B, member RAS oncogene family
  ENSP ID: ENSP00000450285
MTSRSTARPNGQPQASKICQFKLVLLGESAVGKSSLVLRFVKGQFHEYQESTIGGNLCPSKDMGEGTTATGQS

SEQ ID NO: 70834 - protein, 73 aa, Homo sapiens; identical to SEQ ID NO: 70833
  Payload ID: 14062
  Gene Symbol: RAB5B
  Gene Name: RAB5B, member RAS oncogene family
  ENSP ID: ENSP00000487368

SEQ ID NO: 70835 - protein, 216 aa, Homo sapiens
  Payload ID: 14063
  Gene Symbol: RAB5C
  Gene Name: RAB5C, member RAS oncogene family
  Uniprot ID: P51148
  ENSP ID: ENSP00000345689
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 70836 - protein, 216 aa, Homo sapiens; identical to SEQ ID NO: 70835
  Payload ID: 14063
  Gene Symbol: RAB5C
  Gene Name: RAB5C, member RAS oncogene family
  Uniprot ID: P51148
  ENSP ID: ENSP00000377440

SEQ ID NO: 70837 - protein, 249 aa, Homo sapiens
  Payload ID: 14063
  Gene Symbol: RAB5C
  Gene Name: RAB5C, member RAS oncogene family
  Uniprot ID: P51148
  ENSP ID: ENSP00000447053
MELSWRSPSPLSASLHSTSPHPHALWTTTAGRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 70838 - protein, 74 aa, Homo sapiens
  Payload ID: 14063
  Gene Symbol: RAB5C
  Gene Name: RAB5C, member RAS oncogene family
  ENSP ID: ENSP00000448314
MAGRGGAARPNGPAAGNKICQFKLVLLGESAVGKSSLVLRFVKGQFHEYQESTIGAAFLTQTVCLDDTTVKFEI

SEQ ID NO: 70839 - protein, 124 aa, Homo sapiens
  Payload ID: 14063
  Gene Symbol: RAB5C
  Gene Name: RAB5C, member RAS oncogene family
  ENSP ID: ENSP00000449612
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQAS

SEQ ID NO: 70840 - protein, 91 aa, Homo sapiens
  Payload ID: 14063
  Gene Symbol: RAB5C
  Gene Name: RAB5C, member RAS oncogene family
  ENSP ID: ENSP00000449777
MAGRGGAARPNGPAAGNKICQFKLVLLGESAVGKSSLVLRFVKGQFHEYQESTIGAAFLTQTVCLDDTTVKFEIWDTAGQERYHSLAPMYY

SEQ ID NO: 70841 - protein, 150 aa, Homo sapiens
  Payload ID: 14063
  Gene Symbol: RAB5C
  Gene Name: RAB5C, member RAS oncogene family
  ENSP ID: ENSP00000467144
VKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIGQLLLLPSSLHHSKGISPVCWSRVGLRGPFTTLFFFFFFFF

SEQ ID NO: 70842 - protein, 208 aa, Homo sapiens
  Payload ID: 14064
  Gene Symbol: RAB6A
  Gene Name: RAB6A, member RAS oncogene family
  Uniprot ID: P20340
  ENSP ID: ENSP00000311449
MSTGGDFGNPLRKFKLVFLGEQSVGKTSLITRFMYDSFDNTYQATIGIDFLSKTMYLEDRTIRLQLWDTAGQERFRSLIPSYIRDSAAAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 70843 - protein, 208 aa, Homo sapiens
  Payload ID: 14064
  Gene Symbol: RAB6A
  Gene Name: RAB6A, member RAS oncogene family
  Uniprot ID: P20340
  ENSP ID: ENSP00000336850
MSTGGDFGNPLRKFKLVFLGEQSVGKTSLITRFMYDSFDNTYQATIGIDFLSKTMYLEDRTVRLQLWDTAGQERFRSLIPSYIRDSTVAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 70844 - protein, 87 aa, Homo sapiens
  Payload ID: 14064
  Gene Symbol: RAB6A
  Gene Name: RAB6A, member RAS oncogene family
  ENSP ID: ENSP00000437863
MSTGGDFGNPLRKFKLVFLGEQSVGKTSLITRFMYDSFDNTYQATIGIDFLSKTMYLEDRTMLTHSSKLQSGLMMSEQKEEVMLSSC

SEQ ID NO: 70845 - protein, 71 aa, Homo sapiens
  Payload ID: 14064
  Gene Symbol: RAB6A
  Gene Name: RAB6A, member RAS oncogene family
  ENSP ID: ENSP00000438842
MSTGGDFGNPLRKFKLVFLGEQSVGKTSLITRFMYDSFDNTYQLFRRVAAALPGMESTQDRSREDMIDIKL

SEQ ID NO: 70846 - protein, 87 aa, Homo sapiens; identical to SEQ ID NO: 70844
  Payload ID: 14064
  Gene Symbol: RAB6A
  Gene Name: RAB6A, member RAS oncogene family
  ENSP ID: ENSP00000440469

SEQ ID NO: 70847 - protein, 87 aa, Homo sapiens; identical to SEQ ID NO: 70844
  Payload ID: 14064
  Gene Symbol: RAB6A
  Gene Name: RAB6A, member RAS oncogene family
  ENSP ID: ENSP00000443470

SEQ ID NO: 70848 - protein, 175 aa, Homo sapiens
  Payload ID: 14064
  Gene Symbol: RAB6A
  Gene Name: RAB6A, member RAS oncogene family
  Uniprot ID: P20340
  ENSP ID: ENSP00000443782
MYDSFDNTYQATIGIDFLSKTMYLEDRTIRLQLWDTAGQERFRSLIPSYIRDSAAAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 70849 - protein, 104 aa, Homo sapiens
  Payload ID: 14064
  Gene Symbol: RAB6A
  Gene Name: RAB6A, member RAS oncogene family
  Uniprot ID: P20340
  ENSP ID: ENSP00000445350
MSTGGDFGNPLRKFKLVFLGEQSVGKTSLITRFMYDSFDNTYQATIGIDFLSKTMYLEDRTLFRRVAAALPGMESTQDRSREDMIDIKLEKPQEQPVSEGGCSC

SEQ ID NO: 70850 - protein, 208 aa, Homo sapiens
  Payload ID: 14065
  Gene Symbol: RAB6B
  Gene Name: RAB6B, member RAS oncogene family
  Uniprot ID: Q9NRW1
  ENSP ID: ENSP00000285208
MSAGGDFGNPLRKFKLVFLGEQSVGKTSLITRFMYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSAKTGYNVKQLFRRVASALPGMENVQEKSKEGMIDIKLDKPQEPPASEGGCSC

SEQ ID NO: 70851 - protein, 49 aa, Homo sapiens
  Payload ID: 14065
  Gene Symbol: RAB6B
  Gene Name: RAB6B, member RAS oncogene family
  ENSP ID: ENSP00000417433
MYDSFDNTYQATIGIDFLSKTMYLEDRTVRLQLWDTAGQERFRSLIPSY

SEQ ID NO: 70852 - protein, 71 aa, Homo sapiens
  Payload ID: 14065
  Gene Symbol: RAB6B
  Gene Name: RAB6B, member RAS oncogene family
  ENSP ID: ENSP00000418540
MSAGGDFGNPLRKFKLVFLGEQSVGKTSLITRCCWQLQLRGAWFIDWGAMCTSENILTSPPSSQYTCLGQV

SEQ ID NO: 70853 - protein, 195 aa, Homo sapiens
  Payload ID: 14065
  Gene Symbol: RAB6B
  Gene Name: RAB6B, member RAS oncogene family
  Uniprot ID: Q9NRW1
  ENSP ID: ENSP00000419381
MWHMTRNWPLVGKTSLITRFMYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSAKTGYNVKQLFRRVASALPGMENVQEKSKEGMIDIKLDKPQEPPASEGGCSC

SEQ ID NO: 70854 - protein, 83 aa, Homo sapiens
  Payload ID: 14065
  Gene Symbol: RAB6B
  Gene Name: RAB6B, member RAS oncogene family
  ENSP ID: ENSP00000419526
MYLEDRTVRLQLWDTAGQERFRSLIPSYIRDSTVAVVVYDITNLNSFQQTSKWIDDVRTERGSDVIIMLVGNKTDLADKRQIT

SEQ ID NO: 70855 - protein, 124 aa, Homo sapiens
  Payload ID: 14065
  Gene Symbol: RAB6B
  Gene Name: RAB6B, member RAS oncogene family
  ENSP ID: ENSP00000419941
MYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSA

SEQ ID NO: 70856 - protein, 208 aa, Homo sapiens; identical to SEQ ID NO: 70850
  Payload ID: 14065
  Gene Symbol: RAB6B
  Gene Name: RAB6B, member RAS oncogene family
  Uniprot ID: Q9NRW1
  ENSP ID: ENSP00000437797

SEQ ID NO: 70857 - protein, 254 aa, Homo sapiens
  Payload ID: 14066
  Gene Symbol: RAB6C
  Gene Name: RAB6C, member RAS oncogene family
  Uniprot ID: Q9H0N0
  ENSP ID: ENSP00000387307
MSAGGDFGNPLRKFKLVFLGEQSVAKTSLITRFRYDSFDNTYQAIIGIDFLSKTMYLEDGTIGLRLWDTAGQERLRSLIPRYIRDSAAAVVVYDITNVNSFQQTTKWIDDVRTERGSDVIITLVGNRTDLADKRQVSVEEGERKAKGLNVTFIETRAKAGYNVKQLFRRVAAALPGMESTQDGSREDMSDIKLEKPQEQTVSEGGCSCYSPMSSSTLPQKPPYSFIDCSVNIGLNLFPSLITFCNSSLLPVSWR

SEQ ID NO: 70858 - protein, 207 aa, Homo sapiens
  Payload ID: 14067
  Gene Symbol: RAB7A
  Gene Name: RAB7A, member RAS oncogene family
  Uniprot ID: P51149
  ENSP ID: ENSP00000265062
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIPYFETSAKEAINVEQAFQTIARNALKQETEVELYNEFPEPIKLDKNDRAKASAESCSC

SEQ ID NO: 70859 - protein, 134 aa, Homo sapiens
  Payload ID: 14067
  Gene Symbol: RAB7A
  Gene Name: RAB7A, member RAS oncogene family
  ENSP ID: ENSP00000417155
MTSRKKVLLKVIILGDSGVGKTSLMNQYVNKKFSNQYKATIGADFLTKEVMVDDRLVTMQVATKRAQAWCYSKNNIPYFETSAKEAINVEQAFQTIARNALKQETEVELYNEFPEPIKLDKNDRAKASAESCSC

SEQ ID NO: 70860 - protein, 98 aa, Homo sapiens
  Payload ID: 14067
  Gene Symbol: RAB7A
  Gene Name: RAB7A, member RAS oncogene family
  ENSP ID: ENSP00000417189
MTSRKKVLLKVIILGDSGVGKTSLMNQYVNKKFSNQYKATIGADFLTKEAINVEQAFQTIARNALKQETEVELYNEFPEPIKLDKNDRAKASAESCSC

SEQ ID NO: 70861 - protein, 160 aa, Homo sapiens
  Payload ID: 14067
  Gene Symbol: RAB7A
  Gene Name: RAB7A, member RAS oncogene family
  ENSP ID: ENSP00000417668
MTSRKKVLLKVIILGDSGVGKTSLMNQYVNKKFSNQYKATIGADFLTKEVMVDDRLVTMQIWDTAGQERFQSLGVAFYRGADCCVLVATKRAQAWCYSKNNIPYFETSAKEAINVEQAFQTIARNALKQETEVELYNEFPEPIKLDKNDRAKASAESCSC

SEQ ID NO: 70862 - protein, 150 aa, Homo sapiens
  Payload ID: 14067
  Gene Symbol: RAB7A
  Gene Name: RAB7A, member RAS oncogene family
  ENSP ID: ENSP00000417978
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIP

SEQ ID NO: 70863 - protein, 91 aa, Homo sapiens
  Payload ID: 14067
  Gene Symbol: RAB7A
  Gene Name: RAB7A, member RAS oncogene family
  ENSP ID: ENSP00000418283
MTSRKKVLLKVIILGDSGVGKTSLMNQYVNKKFSNQYKATIGADFLTKEVMVDDRLVTMQETEVELYNEFPEPIKLDKNDRAKASAESCSC

SEQ ID NO: 70864 - protein, 116 aa, Homo sapiens
  Payload ID: 14067
  Gene Symbol: RAB7A
  Gene Name: RAB7A, member RAS oncogene family
  ENSP ID: ENSP00000418955
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTKRAQAWCYSKNNIPYFETSAK

SEQ ID NO: 70865 - protein, 199 aa, Homo sapiens
  Payload ID: 14068
  Gene Symbol: RAB7B
  Gene Name: RAB7B, member RAS oncogene family
  Uniprot ID: Q96AH8
  ENSP ID: ENSP00000479762
MNPRKKVDLKLIIVGAIGVGKTSLLHQYVHKTFYEEYQTTLGASILSKIIILGDTTLKLQIWDTGGQERFRSMVSTFYKGSDGCILAFDVTDLESFEALDIWRGDVLAKIVPMEQSYPMVLLGNKIDLADRKVPQEVAQGWCREKDIPYFEVSAKNDINVVQAFEMLASRALSRYQSILENHLTESIKLSPDQSRSRCC

SEQ ID NO: 70866 - protein, 199 aa, Homo sapiens; identical to SEQ ID NO: 70865
  Payload ID: 14068
  Gene Symbol: RAB7B
  Gene Name: RAB7B, member RAS oncogene family
  Uniprot ID: Q96AH8
  ENSP ID: ENSP00000482499

SEQ ID NO: 70867 - protein, 157 aa, Homo sapiens
  Payload ID: 14068
  Gene Symbol: RAB7B
  Gene Name: RAB7B, member RAS oncogene family
  ENSP ID: ENSP00000485386
MNPRKKVDLKLIIVGAIGVGKTSLLHQYVHKTFYEEYQTTLGASILSKIIILGDTTLKLQIWDTGGQERFRSMVSTFYKGSDGCILAFDVTDLESFEALDIWRGDVLAKIVPMEQSYPMVLLGNKIDLADRKYQSILENHLTESIKLSPDQSRSRCC

SEQ ID NO: 70868 - protein, 199 aa, Homo sapiens; identical to SEQ ID NO: 70865
  Payload ID: 14068
  Gene Symbol: RAB7B
  Gene Name: RAB7B, member RAS oncogene family
  Uniprot ID: Q96AH8
  ENSP ID: ENSP00000485468

SEQ ID NO: 70869 - protein, 91 aa, Homo sapiens
  Payload ID: 14068
  Gene Symbol: RAB7B
  Gene Name: RAB7B, member RAS oncogene family
  ENSP ID: ENSP00000485563
  MOD_RES (1)..(1): Any amino acid
XDIWRGDVLAKIVPMEQSYPMVLLGNKIDLADRKVPQEVAQGWCREKDIPYFEVSAKNDINVVQAFEMLASRALSRPSLSRERKSREVSLS

SEQ ID NO: 70870 - protein, 207 aa, Homo sapiens
  Payload ID: 14069
  Gene Symbol: RAB8A
  Gene Name: RAB8A, member RAS oncogene family
  Uniprot ID: P61006
  ENSP ID: ENSP00000300935
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 70871 - protein, 207 aa, Homo sapiens
  Payload ID: 14069
  Gene Symbol: RAB8A
  Gene Name: RAB8A, member RAS oncogene family
  Uniprot ID: P61006
  ENSP ID: ENSP00000467501
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENRYQSKNGQKIGRQQPPGEQPGSQNHTGPAEEEQLFPMCSSVRNTALL

SEQ ID NO: 70872 - protein, 207 aa, Homo sapiens
  Payload ID: 14070
  Gene Symbol: RAB8B
  Gene Name: RAB8B, member RAS oncogene family
  Uniprot ID: Q92930
  ENSP ID: ENSP00000312734
MAKTYDYLFKLLLIGDSGVGKTCLLFRFSEDAFNTTFISTIGIDFKIRTIELDGKKIKLQIWDTAGQERFRTITTAYYRGAMGIMLVYDITNEKSFDNIKNWIRNIEEHASSDVERMILGNKCDMNDKRQVSKERGEKLAIDYGIKFLETSAKSSANVEEAFFTLARDIMTKLNRKMNDSNSAGAGGPVKITENRSKKTSFFRCSLL

SEQ ID NO: 70873 - protein, 48 aa, Homo sapiens
  Payload ID: 14070
  Gene Symbol: RAB8B
  Gene Name: RAB8B, member RAS oncogene family
  ENSP ID: ENSP00000453111
MAKTYDYLFKLLLIGDSGVGKTCLLFRFSEDAFNTTFISTIVRPHIEE

SEQ ID NO: 70874 - protein, 47 aa, Homo sapiens
  Payload ID: 14070
  Gene Symbol: RAB8B
  Gene Name: RAB8B, member RAS oncogene family
  ENSP ID: ENSP00000453236
MAKTYDYLFKLLLIGDSGVGKTCLLFRFSEDAFNTTFISTIEQLPVL

SEQ ID NO: 70875 - protein, 92 aa, Homo sapiens
  Payload ID: 14070
  Gene Symbol: RAB8B
  Gene Name: RAB8B, member RAS oncogene family
  ENSP ID: ENSP00000453679
MAKTYDYLFKLLLIGDSGVGKTCLLFRFSEDAFNTTFISTIGIDFKIRTIELDGKKIKLQIWDTAGQERFRTITTAYYRGAMEGILGIKRTS

SEQ ID NO: 70876 - protein, 188 aa, Homo sapiens
  Payload ID: 14070
  Gene Symbol: RAB8B
  Gene Name: RAB8B, member RAS oncogene family
  ENSP ID: ENSP00000453982
MAKTYDYLFKLLLIGDSGVGKTCLLFRFSEDAFNTTFISTIGIDFKIRTIELDGKKIKLQIWDTAGQERFRTITTAYYRGAMGIMLVYDITNEKSFDNIKNWIRNIEEHASSDVERMILGNKCDMNDKRQVSKERGEKLAIDYGIKFLETSAKSSANVEEAFFTLARDIMTKLNRKMVCITYNFYFHY

SEQ ID NO: 70877 - protein, 321 aa, Homo sapiens
  Payload ID: 14071
  Gene Symbol: RABEPK
  Gene Name: Rab9 effector protein with kelch motifs
  Uniprot ID: Q7Z6M1
  ENSP ID: ENSP00000259460
MKQLPVLEPGDKPRKATWYTLTVPGDSPCARVGHSCSYLPPVGNAKRGKVFIVGGANPNRSFSDVHTMDLETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 70878 - protein, 372 aa, Homo sapiens
  Payload ID: 14071
  Gene Symbol: RABEPK
  Gene Name: Rab9 effector protein with kelch motifs
  Uniprot ID: Q7Z6M1
  ENSP ID: ENSP00000362639
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 70879 - protein, 154 aa, Homo sapiens
  Payload ID: 14071
  Gene Symbol: RABEPK
  Gene Name: Rab9 effector protein with kelch motifs
  ENSP ID: ENSP00000362645
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPAFKSWGFWTVLANPKYHLHSSLMFKPGRGPRQK

SEQ ID NO: 70880 - protein, 372 aa, Homo sapiens; identical to SEQ ID NO: 70878
  Payload ID: 14071
  Gene Symbol: RABEPK
  Gene Name: Rab9 effector protein with kelch motifs
  Uniprot ID: Q7Z6M1
  ENSP ID: ENSP00000377683

SEQ ID NO: 70881 - protein, 244 aa, Homo sapiens
  Payload ID: 14071
  Gene Symbol: RABEPK
  Gene Name: Rab9 effector protein with kelch motifs
  ENSP ID: ENSP00000402234
GRGSPDTGSITVSGRESESFRGVGPSRVQRTGKGLPWLRPGHFDRISLFFPDPVSYPLELPRGDEICWAGSGGCCGRSRPREASLTELWTLGTAVSGLGRRYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERG

SEQ ID NO: 70882 - protein, 154 aa, Homo sapiens; identical to SEQ ID NO: 70879
  Payload ID: 14071
  Gene Symbol: RABEPK
  Gene Name: Rab9 effector protein with kelch motifs
  ENSP ID: ENSP00000487422

SEQ ID NO: 70883 - protein, 201 aa, Homo sapiens
  Payload ID: 14072
  Gene Symbol: RAB9A
  Gene Name: RAB9A, member RAS oncogene family
  Uniprot ID: P51151
  ENSP ID: ENSP00000420127
MAGKSSLFKVILLGDGGVGKSSLMNRYVTNKFDTQLFHTIGVEFLNKDLEVDGHFVTMQIWDTAGQERFRSLRTPFYRGSDCCLLTFSVDDSQSFQNLSNWKKEFIYYADVKEPESFPFVILGNKIDISERQVSTEEAQAWCRDNGDYPYFETSAKDATNVAAAFEEAVRRVLATEDRSDHLIQTDTVNLHRKPKPSSSCC

SEQ ID NO: 70884 - protein, 201 aa, Homo sapiens; identical to SEQ ID NO: 70883
  Payload ID: 14072
  Gene Symbol: RAB9A
  Gene Name: RAB9A, member RAS oncogene family
  Uniprot ID: P51151
  ENSP ID: ENSP00000480777

SEQ ID NO: 70885 - protein, 201 aa, Homo sapiens
  Payload ID: 14073
  Gene Symbol: RAB9B
  Gene Name: RAB9B, member RAS oncogene family
  Uniprot ID: Q9NP90
  ENSP ID: ENSP00000243298
MSGKSLLLKVILLGDGGVGKSSLMNRYVTNKFDSQAFHTIGVEFLNRDLEVDGRFVTLQIWDTAGQERFKSLRTPFYRGADCCLLTFSVDDRQSFENLGNWQKEFIYYADVKDPEHFPFVVLGNKVDKEDRQVTTEEAQTWCMENGDYPYLETSAKDDTNVTVAFEEAVRQVLAVEEQLEHCMLGHTIDLNSGSKAGSSCC

SEQ ID NO: 70886 - protein, 829 aa, Homo sapiens
  Payload ID: 14074
  Gene Symbol: RABEP1
  Gene Name: rabaptin, RAB GTPase binding effector protein 1
  Uniprot ID: Q15276
  ENSP ID: ENSP00000339569
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQATVEQLMFEEKNKAQRLQTELDVSEQVQRDFVKLSQTLQVQLERIRQADSLERIRAILNDTKLTDINQLPET

SEQ ID NO: 70887 - protein, 862 aa, Homo sapiens
  Payload ID: 14074
  Gene Symbol: RABEP1
  Gene Name: rabaptin, RAB GTPase binding effector protein 1
  Uniprot ID: Q15276
  ENSP ID: ENSP00000445408
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 70888 - protein, 109 aa, Homo sapiens
  Payload ID: 14074
  Gene Symbol: RABEP1
  Gene Name: rabaptin, RAB GTPase binding effector protein 1
  ENSP ID: ENSP00000459550
MAQPGPASQPDGEGKGSIFGGLSERGNWDVFRLHFNDHLLHLVSGKKTLFFHNPTLLLHTEARYRELVVLNRSVSLQQRVAELEKINAEFLRAQQQLEQEFNQKRAKFK

SEQ ID NO: 70889 - protein, 192 aa, Homo sapiens
  Payload ID: 14074
  Gene Symbol: RABEP1
  Gene Name: rabaptin, RAB GTPase binding effector protein 1
  ENSP ID: ENSP00000460980
KKADVEEEIKIPVVCALTQEESSAQLSNEEKTPFKIKITDRSSYPEVTTNILEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPS

SEQ ID NO: 70890 - protein, 153 aa, Homo sapiens
  Payload ID: 14074
  Gene Symbol: RABEP1
  Gene Name: rabaptin, RAB GTPase binding effector protein 1
  ENSP ID: ENSP00000466981
  MOD_RES (1)..(1): Any amino acid
XFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVRHLGNHIQSTKAVLGDRTLPIPDLTTGSS

SEQ ID NO: 70891 - protein, 101 aa, Homo sapiens
  Payload ID: 14074
  Gene Symbol: RABEP1
  Gene Name: rabaptin, RAB GTPase binding effector protein 1
  ENSP ID: ENSP00000482983
  MOD_RES (1)..(1): Any amino acid
XIATVSENTKQEAIDEVKRQWREEVASLQAVMKETVRDYEHQFHLRLEQERTQWAQYRESAEREIADLRRRLSEGQEEENLENEMKKDPIQDTILHLVVSP

SEQ ID NO: 70892 - protein, 533 aa, Homo sapiens
  Payload ID: 14075
  Gene Symbol: RABEP2
  Gene Name: rabaptin, RAB GTPase binding effector protein 2
  Uniprot ID: Q9H5N1
  ENSP ID: ENSP00000350186
MAAAAPVAADDDERRRRPGAALEDSRSQEGANGEAESGELSRLRAELAGALAEMETMKAVAEVSESTKAEAVAAVQRQCQEEVASLQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 70893 - protein, 569 aa, Homo sapiens
  Payload ID: 14075
  Gene Symbol: RABEP2
  Gene Name: rabaptin, RAB GTPase binding effector protein 2
  Uniprot ID: Q9H5N1
  ENSP ID: ENSP00000350934
MAAAAPVAADDDERRRRPGAALEDSRSQEGANGEAESGELSRLRAELAGALAEMETMKAVAEVSESTKAEAVAAVQRQCQEEVASLQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 70894 - protein, 498 aa, Homo sapiens
  Payload ID: 14075
  Gene Symbol: RABEP2
  Gene Name: rabaptin, RAB GTPase binding effector protein 2
  ENSP ID: ENSP00000442798
MAAAAPVAADDDERRRRPGADSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTEGRQLQKDLESVSRERDELQEGLRRSNEDCAKQMQVLLAQVQNSEQLLRTLQGTVSQAQERVQLQMAELVTTHKCLHHEVKRLNEENQGLRAEQLPSSAPQGSQQEQGEEESLPSSVPELQQLLCCTRQEARARLQAQEHGAERLRIEIVTLREALEEETVARASLEGQLRVQREETEVLEASLCSLRTEMERVQQEQSKAQLPDLLSEQRAKVLRLQAELETSEQVQRDFVRLSQALQVRLERIRQAETLEQVRSIMDEAPLTDVRDIKDT

SEQ ID NO: 70895 - protein, 47 aa, Homo sapiens
  Payload ID: 14075
  Gene Symbol: RABEP2
  Gene Name: rabaptin, RAB GTPase binding effector protein 2
  ENSP ID: ENSP00000454510
METMKAVAEVSESTKAEAVAAVQRQCQEEVASLQAILKEPSSESDPA

SEQ ID NO: 70896 - protein, 245 aa, Homo sapiens
  Payload ID: 14075
  Gene Symbol: RABEP2
  Gene Name: rabaptin, RAB GTPase binding effector protein 2
  ENSP ID: ENSP00000454968
METMKAVAEVSESTKAEAVAAVQRQCQEEVASLQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDTQWEQLQTE

SEQ ID NO: 70897 - protein, 44 aa, Homo sapiens
  Payload ID: 14075
  Gene Symbol: RABEP2
  Gene Name: rabaptin, RAB GTPase binding effector protein 2
  ENSP ID: ENSP00000454974
MEKAHEDSEKLREIVLPMEKEIEELKAKLLRAEELIQEIQRRPR

SEQ ID NO: 70898 - protein, 280 aa, Homo sapiens
  Payload ID: 14075
  Gene Symbol: RABEP2
  Gene Name: rabaptin, RAB GTPase binding effector protein 2
  ENSP ID: ENSP00000457040
PAIEGVGPVTALEDSRSQEGANGEAESGELSRLRAELAGALAEMETMKAVAEVSESTKAEAVAAVQRQCQEEVASLQAILKDSISSYEAQITALKQERQQQQQDCEEKERELGRLKQLLSRAYPLDSLEKQMEKAHEDSEKLREIVLPMEKEIEELKAKLLRAEELIQEIQRRPRHAPSLHGSTELLPLSRDPSPPLEPLEELSGDGGPAAEAFAHNCDDSASISSFSLGGGVGSSSSLPQSRQGLSPEQEETASLVSTGTLVPEGIYLPPPGYQLVPDT

SEQ ID NO: 70899 - protein, 72 aa, Homo sapiens
  Payload ID: 14075
  Gene Symbol: RABEP2
  Gene Name: rabaptin, RAB GTPase binding effector protein 2
  ENSP ID: ENSP00000457495
MEKAHEDSEKLREIVLPMEKEIEELKAKLLRAEELIQEIQRRPRHAPSLHGSTELLPLSRDPSPPLEPLEEL

SEQ ID NO: 70900 - protein, 784 aa, Homo sapiens
  Payload ID: 14076
  Gene Symbol: RBSN
  Gene Name: rabenosyn, RAB effector
  Uniprot ID: Q9H1K0
  ENSP ID: ENSP00000253699
MASLDDPGEVREGFLCPLCLKDLQSFYQLHSHYEEEHSGEDRDVKGQIKSLVQKAKKAKDRLLKREGDDRAESGTQGYESFSYGGVDPYMWEPQELGAVRSHLSDFKKHRAARIDHYVVEVNKLIIRLEKLTAFDRTNTESAKIRAIEKSVVPWVNDQDVPFCPDCGNKFSIRNRRHHCRLCGSIMCKKCMELISLPLANKLTSASKESLSTHTSPSQSPNSVHGSRRGSISSMSSVSSVLDEKDDDRIRCCTHCKDTLLKREQQIDEKEHTPDIVKLYEKLRLCMEKVDQKAPEYIRMAASLNAGETTYSLEHASDLRVEVQKVYELIDALSKKILTLGLNQDPPPHPSNLRLQRMIRYSATLFVQEKLLGLMSLPTKEQFEELKKKRKEEMERKRAVERQAALESQRRLEERQSGLASRAANGEVASLRRGPAPLRKAEGWLPLSGGQGQSEDSDPLLQQIHNITSFIRQAKAAGRMDEVRTLQENLRQLQDEYDQQQTEKAIELSRRQAEEEDLQREQLQMLRERELEREREQFRVASLHTRTRSLDFREIGPFQLEPSREPRTHLAYALDLGSSPVPSSTAPKTPSLSSTQPTRVWSGPPAVGQERLPQSSMPQQHEGPSLNPFDEEDLSSPMEEATTGPPAAGVSLDPSARILKEYNPFEEEDEEEEAVAGNPFIQPDSPAPNPFSEEDEHPQQRLSSPLVPGNPFEEPTCINPFEMDSDSGPEAEEPIEEELLLQQIDNIKAYIFDAKQCGRLDEVEVLTENLRELKHTLAKQKGGTD

SEQ ID NO: 70901 - protein, 88 aa, Homo sapiens
  Payload ID: 14076
  Gene Symbol: RBSN
  Gene Name: rabenosyn, RAB effector
  ENSP ID: ENSP00000387724
MASLDDPGEVREGFLCPLCLKDLQSFYQLHSHYEEEHSGEDRDVKGQIKSKRRGPCLSPAVVESFNSRDSSHQLWCCHRNMIIVVANR

SEQ ID NO: 70902 - protein, 156 aa, Homo sapiens
  Payload ID: 14076
  Gene Symbol: RBSN
  Gene Name: rabenosyn, RAB effector
  ENSP ID: ENSP00000403368
  MOD_RES (1)..(1): Any amino acid
XDTLLKREQQIDEKEHTPDIVKLYEKLRLCMEKVDQKAPEYIRMAASLNAGETTYSLEHASDLRVEVQKVYELIDALSKKILTLGLNQDPPPHPSNLRLQRMIRYSATLFVQEKLLGLMSLPTKEQFEELKKKRKEEMERKRAVERQGLFFFQSFC

SEQ ID NO: 70903 - protein, 55 aa, Homo sapiens
  Payload ID: 14076
  Gene Symbol: RBSN
  Gene Name: rabenosyn, RAB effector
  ENSP ID: ENSP00000414020
MASLDDPGEVREGFLCPLCLKDLQSFYQLHSHYEEEHSGEDRDVKGQIKNVISVS

SEQ ID NO: 70904 - protein, 784 aa, Homo sapiens; identical to SEQ ID NO: 70900
  Payload ID: 14076
  Gene Symbol: RBSN
  Gene Name: rabenosyn, RAB effector
  Uniprot ID: Q9H1K0
  ENSP ID: ENSP00000422551

SEQ ID NO: 70905 - protein, 41 aa, Homo sapiens
  Payload ID: 14076
  Gene Symbol: RBSN
  Gene Name: rabenosyn, RAB effector
  ENSP ID: ENSP00000427038
MASLDDPGEVREGFLCPLCLKDLQSFYQLHSHYEEEHSGED

SEQ ID NO: 70906 - protein, 694 aa, Homo sapiens
  Payload ID: 14077
  Gene Symbol: RPH3A
  Gene Name: rabphilin 3A
  Uniprot ID: Q9Y2J0
  ENSP ID: ENSP00000374036
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 70907 - protein, 694 aa, Homo sapiens; identical to SEQ ID NO: 70906
  Payload ID: 14077
  Gene Symbol: RPH3A
  Gene Name: rabphilin 3A
  Uniprot ID: Q9Y2J0
  ENSP ID: ENSP00000405357

SEQ ID NO: 70908 - protein, 694 aa, Homo sapiens; identical to SEQ ID NO: 70906
  Payload ID: 14077
  Gene Symbol: RPH3A
  Gene Name: rabphilin 3A
  Uniprot ID: Q9Y2J0
  ENSP ID: ENSP00000440384

SEQ ID NO: 70909 - protein, 83 aa, Homo sapiens
  Payload ID: 14077
  Gene Symbol: RPH3A
  Gene Name: rabphilin 3A
  ENSP ID: ENSP00000446556
MTDTVFSNSSNRWMYPSDRPLQSNDKEQLQAGWSVHPGGQPDRQRKQEELTDEEKEIINRVIARAEKMEEMEQERIGRLVDRL

SEQ ID NO: 70910 - protein, 104 aa, Homo sapiens
  Payload ID: 14077
  Gene Symbol: RPH3A
  Gene Name: rabphilin 3A
  ENSP ID: ENSP00000446570
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQ

SEQ ID NO: 70911 - protein, 181 aa, Homo sapiens
  Payload ID: 14077
  Gene Symbol: RPH3A
  Gene Name: rabphilin 3A
  ENSP ID: ENSP00000446780
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPV

SEQ ID NO: 70912 - protein, 39 aa, Homo sapiens
  Payload ID: 14077
  Gene Symbol: RPH3A
  Gene Name: rabphilin 3A
  ENSP ID: ENSP00000446789
MTDTVFSNSSNRWMYPSDRPLQSNDKEQLQAGWSVHPGG

SEQ ID NO: 70913 - protein, 125 aa, Homo sapiens
  Payload ID: 14077
  Gene Symbol: RPH3A
  Gene Name: rabphilin 3A
  ENSP ID: ENSP00000447083
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTK

SEQ ID NO: 70914 - protein, 94 aa, Homo sapiens
  Payload ID: 14077
  Gene Symbol: RPH3A
  Gene Name: rabphilin 3A
  ENSP ID: ENSP00000447306
MTDTVFSNSSNRWMYPSDRPLQSNDKEQLQAGWSVHPGGQPDRQRKQEELTDEEKEIINRVIARAEKMEEMEQERIGRLVDRLENMRKNVAGDG

SEQ ID NO: 70915 - protein, 115 aa, Homo sapiens
  Payload ID: 14077
  Gene Symbol: RPH3A
  Gene Name: rabphilin 3A
  ENSP ID: ENSP00000447505
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVC

SEQ ID NO: 70916 - protein, 12 aa, Homo sapiens
  Payload ID: 14077
  Gene Symbol: RPH3A
  Gene Name: rabphilin 3A
  ENSP ID: ENSP00000447639
MTDTVFSNSSNR

SEQ ID NO: 70917 - protein, 80 aa, Homo sapiens
  Payload ID: 14077
  Gene Symbol: RPH3A
  Gene Name: rabphilin 3A
  ENSP ID: ENSP00000448100
MEEMEQERIGRLVDRLENMRKNVAGDGVNRCILCGEQLGMLGSACVVCEDCKKNVCTKCGVETNNRLHSVWLCKICIEQR

SEQ ID NO: 70918 - protein, 690 aa, Homo sapiens
  Payload ID: 14077
  Gene Symbol: RPH3A
  Gene Name: rabphilin 3A
  Uniprot ID: Q9Y2J0
  ENSP ID: ENSP00000448297
MTDTVFSNSSNRWMYPSDRPLQSKLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 70919 - protein, 60 aa, Homo sapiens
  Payload ID: 14077
  Gene Symbol: RPH3A
  Gene Name: rabphilin 3A
  ENSP ID: ENSP00000448662
MTDTVFSNSSNRWMYPSDRPLQSKLQHSRWTLKDWLCFQVSVKSLKPTNCPSSVDGFSFH

SEQ ID NO: 70920 - protein, 163 aa, Homo sapiens
  Payload ID: 14077
  Gene Symbol: RPH3A
  Gene Name: rabphilin 3A
  ENSP ID: ENSP00000449613
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNRLHSVWLCKICIEQREVWKRSGAWFFKGFPK

SEQ ID NO: 70921 - protein, 120 aa, Homo sapiens
  Payload ID: 14077
  Gene Symbol: RPH3A
  Gene Name: rabphilin 3A
  ENSP ID: ENSP00000449650
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKK

SEQ ID NO: 70922 - protein, 94 aa, Homo sapiens; identical to SEQ ID NO: 70914
  Payload ID: 14077
  Gene Symbol: RPH3A
  Gene Name: rabphilin 3A
  ENSP ID: ENSP00000449705

SEQ ID NO: 70923 - protein, 133 aa, Homo sapiens
  Payload ID: 14077
  Gene Symbol: RPH3A
  Gene Name: rabphilin 3A
  ENSP ID: ENSP00000450216
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCGVETNNR

SEQ ID NO: 70924 - protein, 645 aa, Homo sapiens
  Payload ID: 14077
  Gene Symbol: RPH3A
  Gene Name: rabphilin 3A
  ENSP ID: ENSP00000450347
MTDTVFSNSSNRWMYPSDRPLQSNDKEQRLVDRLENMRKNVAGDGVNRCILCGEQLGMLGSACVVCEDCKKNVCTKCGVETNNRLHSVWLCKICIEQREVWKRSGAWFFKGFPKQVLPQPMPIKKTKPQQPVSEPAAPEQPAPEPKHPARAPARGDSEDRRGPGQKTGPDPASAPGRGNYGPPVRRASEARMSSSSRDSESWDHSGGAGDSSRSPAGLRRANSVQASRPAPGSVQSPAPPQPGQPGTPGGSRPGPGPAGRFPDQKPEVAPSDPGTTAPPREERTGGVGGYPAVGAREDRMSHPSGPYSQASAAAPQPAAARQPPPPEEEEEEANSYDSDEATTLGALEFSLLYDQDNSSLQCTIIKAKGLKPMDSNGLADPYVKLHLLPGASKSNKLRTKTLRNTRNPIWNETLVYHGITDEDMQRKTLRISVCDEDKFGHNEFIGETRFSLKKLKPNQRKNFNICLERVIPMKRAGTTGSARGMALYEEEQVERVGDIEERGKILVSLMYSTQQGGLIVGIIRCVHLAAMDANGYSDPFVKLWLKPDMGKKAKHKTQIKKKTLNPEFNEEFFYDIKHSDLAKKSLDISVWDYDIGKSNDYIGGCQLGISAKGERLKHWYECLKNKDKKIERWHQLQNENHVSSD

SEQ ID NO: 70925 - protein, 127 aa, Homo sapiens
  Payload ID: 14077
  Gene Symbol: RPH3A
  Gene Name: rabphilin 3A
  ENSP ID: ENSP00000450382
MTDTVFSNSSNRWMYPSDRPLQSNDKEQLQAGWSVHPGGQPDRQRKQEELTDEEKEIINRVIARAEKMEEMEQERIGRLVDRLENMRKNVAGDGVNRCILCGEQLGMLGSACVVCEDCKKNVCTKCG

SEQ ID NO: 70926 - protein, 286 aa, Homo sapiens
  Payload ID: 14078
  Gene Symbol: RPH3AL
  Gene Name: rabphilin 3A-like (without C2 domains)
  Uniprot ID: Q9UNE2
  ENSP ID: ENSP00000319210
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKVWKRSGAWFYKGLPKYILPLKTPGRADDPHFRPLPTEPAEREPRSSETSRIYTWARGRVVSSDSDSDSDLSSSSLEDRLPSTGVRDRKGDKPWKESGGSVEAPRMGFTHPPGHLSGCQSSLASGETGTGSADPPGGPRPGLTRRAPVKDTPGRAPAADAAPAGPSSCLG

SEQ ID NO: 70927 - protein, 315 aa, Homo sapiens
  Payload ID: 14078
  Gene Symbol: RPH3AL
  Gene Name: rabphilin 3A-like (without C2 domains)
  Uniprot ID: Q9UNE2
  ENSP ID: ENSP00000328977
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQREVWKRSGAWFYKGLPKYILPLKTPGRADDPHFRPLPTEPAEREPRSSETSRIYTWARGRVVSSDSDSDSDLSSSSLEDRLPSTGVRDRKGDKPWKESGGSVEAPRMGFTHPPGHLSGCQSSLASGETGTGSADPPGGPRPGLTRRAPVKDTPGRAPAADAAPAGPSSCLG

SEQ ID NO: 70928 - protein, 286 aa, Homo sapiens; identical to SEQ ID NO: 70926
  Payload ID: 14078
  Gene Symbol: RPH3AL
  Gene Name: rabphilin 3A-like (without C2 domains)
  Uniprot ID: Q9UNE2
  ENSP ID: ENSP00000438224

SEQ ID NO: 70929 - protein, 37 aa, Homo sapiens
  Payload ID: 14078
  Gene Symbol: RPH3AL
  Gene Name: rabphilin 3A-like (without C2 domains)
  ENSP ID: ENSP00000458643
MADTIFGSGNDQWVCPNDRQLALRAKLQTGWSVHTYQ

SEQ ID NO: 70930 - protein, 126 aa, Homo sapiens
  Payload ID: 14078
  Gene Symbol: RPH3AL
  Gene Name: rabphilin 3A-like (without C2 domains)
  ENSP ID: ENSP00000459001
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIE

SEQ ID NO: 70931 - protein, 157 aa, Homo sapiens
  Payload ID: 14078
  Gene Symbol: RPH3AL
  Gene Name: rabphilin 3A-like (without C2 domains)
  ENSP ID: ENSP00000459666
IFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQRELFYFTIYRVEPSVFL

SEQ ID NO: 70932 - protein, 148 aa, Homo sapiens
  Payload ID: 14078
  Gene Symbol: RPH3AL
  Gene Name: rabphilin 3A-like (without C2 domains)
  ENSP ID: ENSP00000459716
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKVWKRSGAWFYKGLPKYILPLKTPGRADDPHF

SEQ ID NO: 70933 - protein, 193 aa, Homo sapiens
  Payload ID: 14078
  Gene Symbol: RPH3AL
  Gene Name: rabphilin 3A-like (without C2 domains)
  ENSP ID: ENSP00000459795
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQREVWKRSGAWFYKGLPKYILPLKTPGRADDPHFRPLPTEPAEREPRSSE

SEQ ID NO: 70934 - protein, 83 aa, Homo sapiens
  Payload ID: 14078
  Gene Symbol: RPH3AL
  Gene Name: rabphilin 3A-like (without C2 domains)
  ENSP ID: ENSP00000459975
MADTIFGSGNDQWVCPNDRQLALRAKLQTGWSVHTYQTEKQRRKQHLSPAEVEAILQVIQRAERLDVLEQQRIGRLVERLETM

SEQ ID NO: 70935 - protein, 145 aa, Homo sapiens
  Payload ID: 14078
  Gene Symbol: RPH3AL
  Gene Name: rabphilin 3A-like (without C2 domains)
  ENSP ID: ENSP00000459992
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQR

SEQ ID NO: 70936 - protein, 201 aa, Homo sapiens
  Payload ID: 14078
  Gene Symbol: RPH3AL
  Gene Name: rabphilin 3A-like (without C2 domains)
  ENSP ID: ENSP00000460080
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQREVWKRSGAWFYKGLPKYILPLKTPGRADDPHFRPLPTEPAEREPRSSETSRIYTWA

SEQ ID NO: 70937 - protein, 110 aa, Homo sapiens
  Payload ID: 14078
  Gene Symbol: RPH3AL
  Gene Name: rabphilin 3A-like (without C2 domains)
  ENSP ID: ENSP00000460171
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSV

SEQ ID NO: 70938 - protein, 152 aa, Homo sapiens
  Payload ID: 14078
  Gene Symbol: RPH3AL
  Gene Name: rabphilin 3A-like (without C2 domains)
  ENSP ID: ENSP00000460580
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQREVWKRSG

SEQ ID NO: 70939 - protein, 88 aa, Homo sapiens
  Payload ID: 14078
  Gene Symbol: RPH3AL
  Gene Name: rabphilin 3A-like (without C2 domains)
  ENSP ID: ENSP00000461885
MADTIFGSGNDQWVCPNDRQLALRAKLQTGWSVHTYQTEKQRRKQHLSPAEVEAILQVIQRAERLDVLEQQRIGRLVERLETMRRNVM

SEQ ID NO: 70940 - protein, 110 aa, Homo sapiens; identical to SEQ ID NO: 70937
  Payload ID: 14078
  Gene Symbol: RPH3AL
  Gene Name: rabphilin 3A-like (without C2 domains)
  ENSP ID: ENSP00000476362

SEQ ID NO: 70941 - protein, 286 aa, Homo sapiens; identical to SEQ ID NO: 70926
  Payload ID: 14078
  Gene Symbol: RPH3AL
  Gene Name: rabphilin 3A-like (without C2 domains)
  Uniprot ID: Q9UNE2
  ENSP ID: ENSP00000476394

SEQ ID NO: 70942 - protein, 315 aa, Homo sapiens; identical to SEQ ID NO: 70927
  Payload ID: 14078
  Gene Symbol: RPH3AL
  Gene Name: rabphilin 3A-like (without C2 domains)
  Uniprot ID: Q9UNE2
  ENSP ID: ENSP00000479485

SEQ ID NO: 70943 - protein, 315 aa, Homo sapiens; identical to SEQ ID NO: 70927
  Payload ID: 14078
  Gene Symbol: RPH3AL
  Gene Name: rabphilin 3A-like (without C2 domains)
  Uniprot ID: Q9UNE2
  ENSP ID: ENSP00000483035

SEQ ID NO: 70944 - protein, 145 aa, Homo sapiens; identical to SEQ ID NO: 70935
  Payload ID: 14078
  Gene Symbol: RPH3AL
  Gene Name: rabphilin 3A-like (without C2 domains)
  ENSP ID: ENSP00000487593

SEQ ID NO: 70945 - protein, 157 aa, Homo sapiens; identical to SEQ ID NO: 70931
  Payload ID: 14078
  Gene Symbol: RPH3AL
  Gene Name: rabphilin 3A-like (without C2 domains)
  ENSP ID: ENSP00000487624

SEQ ID NO: 70946 - protein, 315 aa, Homo sapiens; identical to SEQ ID NO: 70927
  Payload ID: 14078
  Gene Symbol: RPH3AL
  Gene Name: rabphilin 3A-like (without C2 domains)
  Uniprot ID: Q9UNE2
  ENSP ID: ENSP00000487649

SEQ ID NO: 70947 - protein, 286 aa, Homo sapiens; identical to SEQ ID NO: 70926
  Payload ID: 14078
  Gene Symbol: RPH3AL
  Gene Name: rabphilin 3A-like (without C2 domains)
  Uniprot ID: Q9UNE2
  ENSP ID: ENSP00000487689

SEQ ID NO: 70948 - protein, 117 aa, Homo sapiens
  Payload ID: 14078
  Gene Symbol: RPH3AL
  Gene Name: rabphilin 3A-like (without C2 domains)
  ENSP ID: ENSP00000487768
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRK

SEQ ID NO: 70949 - protein, 286 aa, Homo sapiens; identical to SEQ ID NO: 70926
  Payload ID: 14078
  Gene Symbol: RPH3AL
  Gene Name: rabphilin 3A-like (without C2 domains)
  Uniprot ID: Q9UNE2
  ENSP ID: ENSP00000487851

SEQ ID NO: 70950 - protein, 37 aa, Homo sapiens; identical to SEQ ID NO: 70929
  Payload ID: 14078
  Gene Symbol: RPH3AL
  Gene Name: rabphilin 3A-like (without C2 domains)
  ENSP ID: ENSP00000487862

SEQ ID NO: 70951 - protein, 37 aa, Homo sapiens; identical to SEQ ID NO: 70929
  Payload ID: 14078
  Gene Symbol: RPH3AL
  Gene Name: rabphilin 3A-like (without C2 domains)
  ENSP ID: ENSP00000487865

SEQ ID NO: 70952 - protein, 117 aa, Homo sapiens; identical to SEQ ID NO: 70948
  Payload ID: 14078
  Gene Symbol: RPH3AL
  Gene Name: rabphilin 3A-like (without C2 domains)
  ENSP ID: ENSP00000487877

SEQ ID NO: 70953 - protein, 110 aa, Homo sapiens; identical to SEQ ID NO: 70937
  Payload ID: 14078
  Gene Symbol: RPH3AL
  Gene Name: rabphilin 3A-like (without C2 domains)
  ENSP ID: ENSP00000488018

SEQ ID NO: 70954 - protein, 193 aa, Homo sapiens; identical to SEQ ID NO: 70933
  Payload ID: 14078
  Gene Symbol: RPH3AL
  Gene Name: rabphilin 3A-like (without C2 domains)
  ENSP ID: ENSP00000488103

SEQ ID NO: 70955 - protein, 201 aa, Homo sapiens; identical to SEQ ID NO: 70936
  Payload ID: 14078
  Gene Symbol: RPH3AL
  Gene Name: rabphilin 3A-like (without C2 domains)
  ENSP ID: ENSP00000488105

SEQ ID NO: 70956 - protein, 88 aa, Homo sapiens; identical to SEQ ID NO: 70939
  Payload ID: 14078
  Gene Symbol: RPH3AL
  Gene Name: rabphilin 3A-like (without C2 domains)
  ENSP ID: ENSP00000488111

SEQ ID NO: 70957 - protein, 88 aa, Homo sapiens; identical to SEQ ID NO: 70939
  Payload ID: 14078
  Gene Symbol: RPH3AL
  Gene Name: rabphilin 3A-like (without C2 domains)
  ENSP ID: ENSP00000488116

SEQ ID NO: 70958 - protein, 126 aa, Homo sapiens; identical to SEQ ID NO: 70930
  Payload ID: 14078
  Gene Symbol: RPH3AL
  Gene Name: rabphilin 3A-like (without C2 domains)
  ENSP ID: ENSP00000488186

SEQ ID NO: 70959 - protein, 146 aa, Homo sapiens
  Payload ID: 14078
  Gene Symbol: RPH3AL
  Gene Name: rabphilin 3A-like (without C2 domains)
  ENSP ID: ENSP00000488277
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQRE

SEQ ID NO: 70960 - protein, 145 aa, Homo sapiens; identical to SEQ ID NO: 70935
  Payload ID: 14078
  Gene Symbol: RPH3AL
  Gene Name: rabphilin 3A-like (without C2 domains)
  ENSP ID: ENSP00000488328

SEQ ID NO: 70961 - protein, 148 aa, Homo sapiens; identical to SEQ ID NO: 70932
  Payload ID: 14078
  Gene Symbol: RPH3AL
  Gene Name: rabphilin 3A-like (without C2 domains)
  ENSP ID: ENSP00000488347

SEQ ID NO: 70962 - protein, 126 aa, Homo sapiens; identical to SEQ ID NO: 70930
  Payload ID: 14078
  Gene Symbol: RPH3AL
  Gene Name: rabphilin 3A-like (without C2 domains)
  ENSP ID: ENSP00000488403

SEQ ID NO: 70963 - protein, 117 aa, Homo sapiens; identical to SEQ ID NO: 70948
  Payload ID: 14078
  Gene Symbol: RPH3AL
  Gene Name: rabphilin 3A-like (without C2 domains)
  ENSP ID: ENSP00000488444

SEQ ID NO: 70964 - protein, 146 aa, Homo sapiens; identical to SEQ ID NO: 70959
  Payload ID: 14078
  Gene Symbol: RPH3AL
  Gene Name: rabphilin 3A-like (without C2 domains)
  ENSP ID: ENSP00000488470

SEQ ID NO: 70965 - protein, 83 aa, Homo sapiens; identical to SEQ ID NO: 70934
  Payload ID: 14078
  Gene Symbol: RPH3AL
  Gene Name: rabphilin 3A-like (without C2 domains)
  ENSP ID: ENSP00000488661

SEQ ID NO: 70966 - protein, 152 aa, Homo sapiens; identical to SEQ ID NO: 70938
  Payload ID: 14078
  Gene Symbol: RPH3AL
  Gene Name: rabphilin 3A-like (without C2 domains)
  ENSP ID: ENSP00000488717

SEQ ID NO: 70967 - protein, 146 aa, Homo sapiens; identical to SEQ ID NO: 70959
  Payload ID: 14078
  Gene Symbol: RPH3AL
  Gene Name: rabphilin 3A-like (without C2 domains)
  ENSP ID: ENSP00000488835

SEQ ID NO: 70968 - protein, 146 aa, Homo sapiens; identical to SEQ ID NO: 70959
  Payload ID: 14078
  Gene Symbol: RPH3AL
  Gene Name: rabphilin 3A-like (without C2 domains)
  ENSP ID: ENSP00000488893

SEQ ID NO: 70969 - protein, 83 aa, Homo sapiens; identical to SEQ ID NO: 70934
  Payload ID: 14078
  Gene Symbol: RPH3AL
  Gene Name: rabphilin 3A-like (without C2 domains)
  ENSP ID: ENSP00000488902

SEQ ID NO: 70970 - protein, 632 aa, Homo sapiens
  Payload ID: 14079
  Gene Symbol: RACGAP1
  Gene Name: Rac GTPase activating protein 1
  Uniprot ID: Q9H0H5
  ENSP ID: ENSP00000309871
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETVPYWTRSRRKTGTLQPWNSDSTLNSRQLEPRTETDSVGTPQSNGGMRLHDFVSKTVIKPESCVPCGKRIKFGKLSLKCRDCRVVSHPECRDRCPLPCIPTLIGTPVKIGEGMLADFVSQTSPMIPSIVVHCVNEIEQRGLTETGLYRISGCDRTVKELKEKFLRVKTVPLLSKVDDIHAICSLLKDFLRNLKEPLLTFRLNRAFMEAAEITDEDNSIAAMYQAVGELPQANRDTLAFLMIHLQRVAQSPHTKMDVANLAKVFGPTIVAHAVPNPDPVTMLQDIKRQPKVVERLLSLPLEYWSQFMMVEQENIDPLHVIENSNAFSTPQTPDIKVSLLGPVTTPEHQLLKTPSSSSLSQRVRSTLTKNTPRFGSKSKSATNLGRQGNFFASPMLK

SEQ ID NO: 70971 - protein, 632 aa, Homo sapiens; identical to SEQ ID NO: 70970
  Payload ID: 14079
  Gene Symbol: RACGAP1
  Gene Name: Rac GTPase activating protein 1
  Uniprot ID: Q9H0H5
  ENSP ID: ENSP00000404190

SEQ ID NO: 70972 - protein, 632 aa, Homo sapiens; identical to SEQ ID NO: 70970
  Payload ID: 14079
  Gene Symbol: RACGAP1
  Gene Name: Rac GTPase activating protein 1
  Uniprot ID: Q9H0H5
  ENSP ID: ENSP00000404808

SEQ ID NO: 70973 - protein, 155 aa, Homo sapiens
  Payload ID: 14079
  Gene Symbol: RACGAP1
  Gene Name: Rac GTPase activating protein 1
  ENSP ID: ENSP00000446642
MCGICLSSLCAGWRFSVKEMKSERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGP

SEQ ID NO: 70974 - protein, 117 aa, Homo sapiens
  Payload ID: 14079
  Gene Symbol: RACGAP1
  Gene Name: Rac GTPase activating protein 1
  ENSP ID: ENSP00000446889
MDVANLAKVFGPTIVAHAVPNPDPVTMLQDIKRQPKVVERLLSLPLEYWSQFMMVEQENIDPLHVIENSNAFSTPQTPDIKAVPGGGLCVHFTAGEAEIQKGPPSCGQNKSTAAFNY

SEQ ID NO: 70975 - protein, 139 aa, Homo sapiens
  Payload ID: 14079
  Gene Symbol: RACGAP1
  Gene Name: Rac GTPase activating protein 1
  ENSP ID: ENSP00000447177
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAG

SEQ ID NO: 70976 - protein, 150 aa, Homo sapiens
  Payload ID: 14079
  Gene Symbol: RACGAP1
  Gene Name: Rac GTPase activating protein 1
  ENSP ID: ENSP00000447393
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESG

SEQ ID NO: 70977 - protein, 136 aa, Homo sapiens
  Payload ID: 14079
  Gene Symbol: RACGAP1
  Gene Name: Rac GTPase activating protein 1
  ENSP ID: ENSP00000447429
MCGICLSSLCAGWRFSVKEMKSERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQ

SEQ ID NO: 70978 - protein, 107 aa, Homo sapiens
  Payload ID: 14079
  Gene Symbol: RACGAP1
  Gene Name: Rac GTPase activating protein 1
  ENSP ID: ENSP00000448136
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREML

SEQ ID NO: 70979 - protein, 34 aa, Homo sapiens
  Payload ID: 14079
  Gene Symbol: RACGAP1
  Gene Name: Rac GTPase activating protein 1
  ENSP ID: ENSP00000448507
MRLHDFVSKTVIKPESCVPCGKRIKFGKLSLKCR

SEQ ID NO: 70980 - protein, 293 aa, Homo sapiens
  Payload ID: 14079
  Gene Symbol: RACGAP1
  Gene Name: Rac GTPase activating protein 1
  ENSP ID: ENSP00000448697
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETVPYWTRSRRKTGTLQPWNSDSTLNSRQLEPRTETDSVGTPQSNGGMRLHDFVSKT

SEQ ID NO: 70981 - protein, 129 aa, Homo sapiens
  Payload ID: 14079
  Gene Symbol: RACGAP1
  Gene Name: Rac GTPase activating protein 1
  ENSP ID: ENSP00000448707
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLN

SEQ ID NO: 70982 - protein, 56 aa, Homo sapiens
  Payload ID: 14079
  Gene Symbol: RACGAP1
  Gene Name: Rac GTPase activating protein 1
  ENSP ID: ENSP00000448860
MDTMMLNVRNLFEQLVRRVEILSEGNENLSSWRRTLRISVKSGRGLTMSWGNTRIF

SEQ ID NO: 70983 - protein, 83 aa, Homo sapiens
  Payload ID: 14079
  Gene Symbol: RACGAP1
  Gene Name: Rac GTPase activating protein 1
  ENSP ID: ENSP00000448968
MKAETERSALDVKLKHARNQVDVEIKRRQRAEADCEKLERQIQLIREMLMCDTSGSIQLSEEQKSALAFLNRGQPSSSNAGNK

SEQ ID NO: 70984 - protein, 174 aa, Homo sapiens
  Payload ID: 14079
  Gene Symbol: RACGAP1
  Gene Name: Rac GTPase activating protein 1
  ENSP ID: ENSP00000449170
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKT

SEQ ID NO: 70985 - protein, 130 aa, Homo sapiens
  Payload ID: 14079
  Gene Symbol: RACGAP1
  Gene Name: Rac GTPase activating protein 1
  ENSP ID: ENSP00000449186
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNR

SEQ ID NO: 70986 - protein, 632 aa, Homo sapiens; identical to SEQ ID NO: 70970
  Payload ID: 14079
  Gene Symbol: RACGAP1
  Gene Name: Rac GTPase activating protein 1
  Uniprot ID: Q9H0H5
  ENSP ID: ENSP00000449370

SEQ ID NO: 70987 - protein, 632 aa, Homo sapiens; identical to SEQ ID NO: 70970
  Payload ID: 14079
  Gene Symbol: RACGAP1
  Gene Name: Rac GTPase activating protein 1
  Uniprot ID: Q9H0H5
  ENSP ID: ENSP00000449374

SEQ ID NO: 70988 - protein, 280 aa, Homo sapiens
  Payload ID: 14079
  Gene Symbol: RACGAP1
  Gene Name: Rac GTPase activating protein 1
  ENSP ID: ENSP00000449565
QGNESIVAKTTVTVPNDGGPIEAVSTIETVPYWTRSRRKTGTLQPWNSDSTLNSRQLEPRTETDSVGTPQSNGGMRLHDFVSKTGMLADFVSQTSPMIPSIVVHCVNEIEQRGLTETGLYRISGCDRTVKELKEKFLRVKTVPLLSKVDDIHAICSLLKDFLRNLKEPLLTFRLNRAFMEAAEITDEDNSIAAMYQAVGELPQANRDTLAFLMIHLQRVAQSPHTKMDVANLAKVFGPTIVAHAVPNPDPVTMLQDIKRQPKVVERLLSLPLEYWSQFMM

SEQ ID NO: 70989 - protein, 49 aa, Homo sapiens
  Payload ID: 14079
  Gene Symbol: RACGAP1
  Gene Name: Rac GTPase activating protein 1
  ENSP ID: ENSP00000449574
MDTMMLNVRNLFEQLVRRVEILSEGNEVRLGLFFGEDFQTEEERKEALY

SEQ ID NO: 70990 - protein, 177 aa, Homo sapiens
  Payload ID: 14079
  Gene Symbol: RACGAP1
  Gene Name: Rac GTPase activating protein 1
  ENSP ID: ENSP00000449620
MSCPCFCPVALRMDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESL

SEQ ID NO: 70991 - protein, 155 aa, Homo sapiens
  Payload ID: 14079
  Gene Symbol: RACGAP1
  Gene Name: Rac GTPase activating protein 1
  ENSP ID: ENSP00000449669
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSD

SEQ ID NO: 70992 - protein, 111 aa, Homo sapiens
  Payload ID: 14079
  Gene Symbol: RACGAP1
  Gene Name: Rac GTPase activating protein 1
  ENSP ID: ENSP00000449959
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDT

SEQ ID NO: 70993 - protein, 152 aa, Homo sapiens
  Payload ID: 14079
  Gene Symbol: RACGAP1
  Gene Name: Rac GTPase activating protein 1
  ENSP ID: ENSP00000449963
MKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQ

SEQ ID NO: 70994 - protein, 124 aa, Homo sapiens
  Payload ID: 14079
  Gene Symbol: RACGAP1
  Gene Name: Rac GTPase activating protein 1
  ENSP ID: ENSP00000450064
MKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREK

SEQ ID NO: 70995 - protein, 67 aa, Homo sapiens
  Payload ID: 14079
  Gene Symbol: RACGAP1
  Gene Name: Rac GTPase activating protein 1
  ENSP ID: ENSP00000450074
MCGICLSSLCAGWRFSVKEMKSERQIQLIREMLMCDTSGSIQLSEEQKSALAFLNRGQPSSSNAGNK

SEQ ID NO: 70996 - protein, 776 aa, Homo sapiens
  Payload ID: 14080
  Gene Symbol: ARHGEF6
  Gene Name: Rac/Cdc42 guanine nucleotide exchange factor (GEF) 6
  Uniprot ID: Q15052
  ENSP ID: ENSP00000250617
MNPEEQIVTWLISLGVLESPKKTICDPEEFLKSSLKNGVVLCKLINRLMPGSVEKFCLDPQTEADCINNINDFLKGCATLQVEIFDPDDLYSGVNFSKVLSTLLAVNKATEDQLSERPCGRSSSLSAANTSQTNPQGAVSSTVSGLQRQSKTVEMTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 70997 - protein, 622 aa, Homo sapiens
  Payload ID: 14080
  Gene Symbol: ARHGEF6
  Gene Name: Rac/Cdc42 guanine nucleotide exchange factor (GEF) 6
  Uniprot ID: Q15052
  ENSP ID: ENSP00000359654
MTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 70998 - protein, 622 aa, Homo sapiens; identical to SEQ ID NO: 70997
  Payload ID: 14080
  Gene Symbol: ARHGEF6
  Gene Name: Rac/Cdc42 guanine nucleotide exchange factor (GEF) 6
  Uniprot ID: Q15052
  ENSP ID: ENSP00000359656

SEQ ID NO: 70999 - protein, 68 aa, Homo sapiens
  Payload ID: 14081
  Gene Symbol: RAD1
  Gene Name: RAD1 checkpoint DNA exonuclease
  Uniprot ID: O60671
  ENSP ID: ENSP00000313467
MPLLTQQIQDEDDQYSLVASLDNVRNLSTILKAIHFREHATCFATKNGIKVTVENAKCVQANAFIQGL

SEQ ID NO: 71000 - protein, 282 aa, Homo sapiens
  Payload ID: 14081
  Gene Symbol: RAD1
  Gene Name: RAD1 checkpoint DNA exonuclease
  Uniprot ID: O60671
  ENSP ID: ENSP00000340879
MPLLTQQIQDEDDQYSLVASLDNVRNLSTILKAIHFREHATCFATKNGIKVTVENAKCVQANAFIQAGIFQEFKVQEESVTFRINLTVLLDCLSIFGSSPMPGTLTALRMCYQGYGYPLMLFLEEGGVVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 71001 - protein, 282 aa, Homo sapiens; identical to SEQ ID NO: 71000
  Payload ID: 14081
  Gene Symbol: RAD1
  Gene Name: RAD1 checkpoint DNA exonuclease
  Uniprot ID: O60671
  ENSP ID: ENSP00000371469

SEQ ID NO: 71002 - protein, 84 aa, Homo sapiens
  Payload ID: 14081
  Gene Symbol: RAD1
  Gene Name: RAD1 checkpoint DNA exonuclease
  ENSP ID: ENSP00000421007
MPLLTQQIQDEDDQYSLVASLDNVRNLSTILKAIHFREHATCFATKNGIKVTVENAKCVQANAFIQGHGMVAHTCISSCSGDRG

SEQ ID NO: 71003 - protein, 84 aa, Homo sapiens; identical to SEQ ID NO: 71002
  Payload ID: 14081
  Gene Symbol: RAD1
  Gene Name: RAD1 checkpoint DNA exonuclease
  ENSP ID: ENSP00000423253

SEQ ID NO: 71004 - protein, 84 aa, Homo sapiens; identical to SEQ ID NO: 71002
  Payload ID: 14081
  Gene Symbol: RAD1
  Gene Name: RAD1 checkpoint DNA exonuclease
  ENSP ID: ENSP00000487478

SEQ ID NO: 71005 - protein, 584 aa, Homo sapiens
  Payload ID: 14082
  Gene Symbol: RAD17
  Gene Name: RAD17 checkpoint clamp loader component
  Uniprot ID: O75943
  ENSP ID: ENSP00000282891
MNQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 71006 - protein, 670 aa, Homo sapiens
  Payload ID: 14082
  Gene Symbol: RAD17
  Gene Name: RAD17 checkpoint clamp loader component
  Uniprot ID: O75943
  ENSP ID: ENSP00000303134
MNQVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 71007 - protein, 670 aa, Homo sapiens; identical to SEQ ID NO: 71006
  Payload ID: 14082
  Gene Symbol: RAD17
  Gene Name: RAD17 checkpoint clamp loader component
  Uniprot ID: O75943
  ENSP ID: ENSP00000311227

SEQ ID NO: 71008 - protein, 670 aa, Homo sapiens; identical to SEQ ID NO: 71006
  Payload ID: 14082
  Gene Symbol: RAD17
  Gene Name: RAD17 checkpoint clamp loader component
  Uniprot ID: O75943
  ENSP ID: ENSP00000346271

SEQ ID NO: 71009 - protein, 670 aa, Homo sapiens; identical to SEQ ID NO: 71006
  Payload ID: 14082
  Gene Symbol: RAD17
  Gene Name: RAD17 checkpoint clamp loader component
  Uniprot ID: O75943
  ENSP ID: ENSP00000346938

SEQ ID NO: 71010 - protein, 505 aa, Homo sapiens
  Payload ID: 14082
  Gene Symbol: RAD17
  Gene Name: RAD17 checkpoint clamp loader component
  Uniprot ID: O75943
  ENSP ID: ENSP00000350725
MFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 71011 - protein, 670 aa, Homo sapiens; identical to SEQ ID NO: 71006
  Payload ID: 14082
  Gene Symbol: RAD17
  Gene Name: RAD17 checkpoint clamp loader component
  Uniprot ID: O75943
  ENSP ID: ENSP00000355226

SEQ ID NO: 71012 - protein, 681 aa, Homo sapiens
  Payload ID: 14082
  Gene Symbol: RAD17
  Gene Name: RAD17 checkpoint clamp loader component
  Uniprot ID: O75943
  ENSP ID: ENSP00000370151
MSKTFLRPKVSSTKVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 71013 - protein, 20 aa, Homo sapiens
  Payload ID: 14082
  Gene Symbol: RAD17
  Gene Name: RAD17 checkpoint clamp loader component
  ENSP ID: ENSP00000423060
MNQVTDWVDPSFDDFLECSG

SEQ ID NO: 71014 - protein, 165 aa, Homo sapiens
  Payload ID: 14082
  Gene Symbol: RAD17
  Gene Name: RAD17 checkpoint clamp loader component
  ENSP ID: ENSP00000424289
SDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKMNGIRILSCREQHLPT

SEQ ID NO: 71015 - protein, 169 aa, Homo sapiens
  Payload ID: 14082
  Gene Symbol: RAD17
  Gene Name: RAD17 checkpoint clamp loader component
  ENSP ID: ENSP00000424696
MNQVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNT

SEQ ID NO: 71016 - protein, 184 aa, Homo sapiens
  Payload ID: 14082
  Gene Symbol: RAD17
  Gene Name: RAD17 checkpoint clamp loader component
  ENSP ID: ENSP00000425005
SLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQD

SEQ ID NO: 71017 - protein, 681 aa, Homo sapiens; identical to SEQ ID NO: 71012
  Payload ID: 14082
  Gene Symbol: RAD17
  Gene Name: RAD17 checkpoint clamp loader component
  Uniprot ID: O75943
  ENSP ID: ENSP00000426191

SEQ ID NO: 71018 - protein, 50 aa, Homo sapiens
  Payload ID: 14082
  Gene Symbol: RAD17
  Gene Name: RAD17 checkpoint clamp loader component
  ENSP ID: ENSP00000427673
MFNTESSFHMFPYQSQIAVFKEFLLRATKYNKLQMLGDDLRTDKKIILVE

SEQ ID NO: 71019 - protein, 505 aa, Homo sapiens; identical to SEQ ID NO: 71010
  Payload ID: 14082
  Gene Symbol: RAD17
  Gene Name: RAD17 checkpoint clamp loader component
  Uniprot ID: O75943
  ENSP ID: ENSP00000427743

SEQ ID NO: 71020 - protein, 670 aa, Homo sapiens
  Payload ID: 14082
  Gene Symbol: RAD17
  Gene Name: RAD17 checkpoint clamp loader component
  Uniprot ID: O75943
  ENSP ID: ENSP00000477962
MNQVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCRQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 71021 - protein, 670 aa, Homo sapiens; identical to SEQ ID NO: 71020
  Payload ID: 14082
  Gene Symbol: RAD17
  Gene Name: RAD17 checkpoint clamp loader component
  Uniprot ID: O75943
  ENSP ID: ENSP00000477996

SEQ ID NO: 71022 - protein, 670 aa, Homo sapiens; identical to SEQ ID NO: 71020
  Payload ID: 14082
  Gene Symbol: RAD17
  Gene Name: RAD17 checkpoint clamp loader component
  Uniprot ID: O75943
  ENSP ID: ENSP00000478167

SEQ ID NO: 71023 - protein, 20 aa, Homo sapiens
  Payload ID: 14082
  Gene Symbol: RAD17
  Gene Name: RAD17 checkpoint clamp loader component
  ENSP ID: ENSP00000478321
MNQVTDWVDPSFDDFLECSG

SEQ ID NO: 71024 - protein, 670 aa, Homo sapiens; identical to SEQ ID NO: 71020
  Payload ID: 14082
  Gene Symbol: RAD17
  Gene Name: RAD17 checkpoint clamp loader component
  Uniprot ID: O75943
  ENSP ID: ENSP00000479160

SEQ ID NO: 71025 - protein, 505 aa, Homo sapiens
  Payload ID: 14082
  Gene Symbol: RAD17
  Gene Name: RAD17 checkpoint clamp loader component
  ENSP ID: ENSP00000480230
MFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCRQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 71026 - protein, 50 aa, Homo sapiens; identical to SEQ ID NO: 71018
  Payload ID: 14082
  Gene Symbol: RAD17
  Gene Name: RAD17 checkpoint clamp loader component
  ENSP ID: ENSP00000480453

SEQ ID NO: 71027 - protein, 681 aa, Homo sapiens
  Payload ID: 14082
  Gene Symbol: RAD17
  Gene Name: RAD17 checkpoint clamp loader component
  ENSP ID: ENSP00000480786
MSKTFLRPKVSSTKVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCRQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 71028 - protein, 505 aa, Homo sapiens; identical to SEQ ID NO: 71025
  Payload ID: 14082
  Gene Symbol: RAD17
  Gene Name: RAD17 checkpoint clamp loader component
  ENSP ID: ENSP00000481388

SEQ ID NO: 71029 - protein, 165 aa, Homo sapiens; identical to SEQ ID NO: 71014
  Payload ID: 14082
  Gene Symbol: RAD17
  Gene Name: RAD17 checkpoint clamp loader component
  ENSP ID: ENSP00000481820

SEQ ID NO: 71030 - protein, 670 aa, Homo sapiens; identical to SEQ ID NO: 71020
  Payload ID: 14082
  Gene Symbol: RAD17
  Gene Name: RAD17 checkpoint clamp loader component
  Uniprot ID: O75943
  ENSP ID: ENSP00000482371

SEQ ID NO: 71031 - protein, 184 aa, Homo sapiens
  Payload ID: 14082
  Gene Symbol: RAD17
  Gene Name: RAD17 checkpoint clamp loader component
  ENSP ID: ENSP00000482765
SLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCRQTQLLPYLALLTIPMRNQD

SEQ ID NO: 71032 - protein, 670 aa, Homo sapiens; identical to SEQ ID NO: 71006
  Payload ID: 14082
  Gene Symbol: RAD17
  Gene Name: RAD17 checkpoint clamp loader component
  Uniprot ID: O75943
  ENSP ID: ENSP00000482775

SEQ ID NO: 71033 - protein, 584 aa, Homo sapiens
  Payload ID: 14082
  Gene Symbol: RAD17
  Gene Name: RAD17 checkpoint clamp loader component
  ENSP ID: ENSP00000483115
MNQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCRQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 71034 - protein, 169 aa, Homo sapiens; identical to SEQ ID NO: 71015
  Payload ID: 14082
  Gene Symbol: RAD17
  Gene Name: RAD17 checkpoint clamp loader component
  ENSP ID: ENSP00000483809

SEQ ID NO: 71035 - protein, 681 aa, Homo sapiens; identical to SEQ ID NO: 71027
  Payload ID: 14082
  Gene Symbol: RAD17
  Gene Name: RAD17 checkpoint clamp loader component
  ENSP ID: ENSP00000484227

SEQ ID NO: 71036 - protein, 670 aa, Homo sapiens; identical to SEQ ID NO: 71020
  Payload ID: 14082
  Gene Symbol: RAD17
  Gene Name: RAD17 checkpoint clamp loader component
  Uniprot ID: O75943
  ENSP ID: ENSP00000484854

SEQ ID NO: 71037 - protein, 495 aa, Homo sapiens
  Payload ID: 14083
  Gene Symbol: RAD18
  Gene Name: RAD18 E3 ubiquitin protein ligase
  Uniprot ID: Q9NS91
  ENSP ID: ENSP00000264926
MDSLAESRWPPGLAVMKTIDDLLRCGICFEYFNIAMIIPQCSHNYCSLCIRKFLSYKTQCPTCCVTVTEPDLKNNRILDELVKSLNFARNHLLQFALESPAKSPASSSSKNLAVKVYTPVASRQSLKQGSRLMDNFLIREMSGSTSELLIKENKSKFSPQKEASPAAKTKETRSVEEIAPDPSEAKRPEPPSTSTLKQVTKVDCPVCGVNIPESHINKHLDSCLSREEKKESLRSSVHKRKPLPKTVYNLLSDRDLKKKLKEHGLSIQGNKQQLIKRHQEFVHMYNAQCDALHPKSAAEIVREIENIEKTRMRLEASKLNESVMVFTKDQTEKEIDEIHSKYRKKHKSEFQLLVDQARKGYKKIAGMSQKTVTITKEDESTEKLSSVCMGQEDNMTSVTNHFSQSKLDSPEELEPDREEDSSSCIDIQEVLSSSESDSCNSSSSDIIRDLLEEEEAWEASHKNDLQDTEISPRQNRRTRAAESAEIEPRNKRNRN

SEQ ID NO: 71038 - protein, 79 aa, Homo sapiens
  Payload ID: 14083
  Gene Symbol: RAD18
  Gene Name: RAD18 E3 ubiquitin protein ligase
  ENSP ID: ENSP00000393783
LSSVCMGQEDNMTSVTNHFSQSKLDSPEELEPDREEDSSSCIDIQEVLSSSESDSCNSSSSDIIRDLLEEEEAWEASHK

SEQ ID NO: 71039 - protein, 53 aa, Homo sapiens
  Payload ID: 14083
  Gene Symbol: RAD18
  Gene Name: RAD18 E3 ubiquitin protein ligase
  ENSP ID: ENSP00000397852
MDSLAESRWPPGLAVMKTIDDLLRCGICFEYFNIAMIIPQCSHNYCHRAGSEK

SEQ ID NO: 71040 - protein, 126 aa, Homo sapiens
  Payload ID: 14083
  Gene Symbol: RAD18
  Gene Name: RAD18 E3 ubiquitin protein ligase
  ENSP ID: ENSP00000399620
MDSLAESRWPPGLAVMKTIDDLLRCGICFEYFNIAMIIPQCSHNYCSLCIRKFLSYKTQCPTCCVTVTEPDLKNNRILDELESSAAVCFRVTSQISCFFLFKESCCQSIYSCSLQTVFKAGEQVNG

SEQ ID NO: 71041 - protein, 310 aa, Homo sapiens
  Payload ID: 14083
  Gene Symbol: RAD18
  Gene Name: RAD18 E3 ubiquitin protein ligase
  ENSP ID: ENSP00000402049
MDSLAESRWPPGLAVMKTIDDLLRCGICFEYFNIAMIIPQCSHNYCSLCIRKFLSYKTQCPTCCVTVTEPDLKNNRILDELVKSLNFARNHLLQFALESPAKSPASSSSKNLAVKVYTPVASRQSLKQGSRLMDNFLIREMSGSTSELLIKENKSKFSPQKEASPAAKTKETRSVEEIAPDPSEAKRPEPPSTSTLKQVTKVDCPVCGVNIPESHINKHLDSCLSREEKKESLRSSVHKRKPLPKTVYNLLSDRDLKKKLKEHGLSIQGNKQQLIKRHQEFVHMYNAQCDALHPKSGNGFYKGPNRKGNR

SEQ ID NO: 71042 - protein, 131 aa, Homo sapiens
  Payload ID: 14083
  Gene Symbol: RAD18
  Gene Name: RAD18 E3 ubiquitin protein ligase
  ENSP ID: ENSP00000412054
  MOD_RES (1)..(1): Any amino acid
XAGMSQKTVTITKEDESTEKLSSVCMGQEDNMTSVTNHFSQSKLDSPEELEPDREEDSSSCIDIQEVLSSSESDSCNSSSSDIIRDLLEEEEAWEASHKLYFSKRRYIFQGSCVSTNPFFCKRTACFYSKL

SEQ ID NO: 71043 - protein, 91 aa, Homo sapiens
  Payload ID: 14083
  Gene Symbol: RAD18
  Gene Name: RAD18 E3 ubiquitin protein ligase
  ENSP ID: ENSP00000412261
MDSLAESRWPPGLAVMKTIDDLLRCGICFEYFNIAMIIPQCSHNYCSLCIRKFLSYKTQCPTCCVTVTEPDLKNNRILDELVKSLNFARNH

SEQ ID NO: 71044 - protein, 631 aa, Homo sapiens
  Payload ID: 14084
  Gene Symbol: RAD21
  Gene Name: RAD21 cohesin complex component
  Uniprot ID: O60216
  ENSP ID: ENSP00000297338
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGILDDKLISNNDGGIFDDPPALSEAGVMLPEQPAHDDMDEDDNVSMGGPDSPDSVDPVEPMPTMTDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 71045 - protein, 225 aa, Homo sapiens
  Payload ID: 14084
  Gene Symbol: RAD21
  Gene Name: RAD21 cohesin complex component
  ENSP ID: ENSP00000427923
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGND

SEQ ID NO: 71046 - protein, 176 aa, Homo sapiens
  Payload ID: 14084
  Gene Symbol: RAD21
  Gene Name: RAD21 cohesin complex component
  ENSP ID: ENSP00000428003
MEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 71047 - protein, 120 aa, Homo sapiens
  Payload ID: 14084
  Gene Symbol: RAD21
  Gene Name: RAD21 cohesin complex component
  ENSP ID: ENSP00000428158
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQP

SEQ ID NO: 71048 - protein, 135 aa, Homo sapiens
  Payload ID: 14084
  Gene Symbol: RAD21
  Gene Name: RAD21 cohesin complex component
  ENSP ID: ENSP00000428513
MEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 71049 - protein, 228 aa, Homo sapiens
  Payload ID: 14084
  Gene Symbol: RAD21
  Gene Name: RAD21 cohesin complex component
  ENSP ID: ENSP00000429342
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGI

SEQ ID NO: 71050 - protein, 69 aa, Homo sapiens
  Payload ID: 14084
  Gene Symbol: RAD21
  Gene Name: RAD21 cohesin complex component
  ENSP ID: ENSP00000430273
MLHGLQRALAKTGAESISLLELCRNTNRKQAAAKFYSFLVLKKQQAIELTQEEPYSDIIATPGPRFHII

SEQ ID NO: 71051 - protein, 124 aa, Homo sapiens
  Payload ID: 14084
  Gene Symbol: RAD21
  Gene Name: RAD21 cohesin complex component
  ENSP ID: ENSP00000430524
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDL

SEQ ID NO: 71052 - protein, 65 aa, Homo sapiens
  Payload ID: 14085
  Gene Symbol: RAD21L1
  Gene Name: RAD21 cohesin complex component like 1
  ENSP ID: ENSP00000246108
MFYTHVLMSKRGPLAKIWLAAHWEKKLTKAHVFECNLEITIEKILSPKVKIALRTSGHLLLGVVR

SEQ ID NO: 71053 - protein, 521 aa, Homo sapiens
  Payload ID: 14085
  Gene Symbol: RAD21L1
  Gene Name: RAD21 cohesin complex component like 1
  Uniprot ID: Q9H4I0
  ENSP ID: ENSP00000385925
MFYTHVLMSKRGPLAKIWLAAHWEKKLTKAHVFECNLEITIEKILSPKVKIALRTSGHLLLGVVRIYNRKAKYLLADCSEAFLKMKMTFCPGLVDLPKENFEASYNAITLPEEFHDFDTQNMNAIDVSEHFTQNQSRPEEITLRENFDNDLIFQAESFGEESEILRRHSFFDDNILLNSSGPLIEHSSGSLTGERSLFYDSGDGFGDEGAAGEMIDNLLQDDQNILLEDMHLNREISLPSEPPNSLAVEPDNSECICVPENEKMNETILLSTEEEGFTLDPIDISDIAEKRKGKKRRLLIDPIKELSSKVIHKQLTSFADTLMVLELAPPTQRLMMWKKRGGVHTLLSTAAQDLIHAELKMLFTKCFLSSGFKLGRKMIQKESVREEVGNQNIVETSMMQEPNYQQELSKPQTWKDVIGGSQHSSHEDTNKNINSEESLSNEENIETERWNGRILQMLNRLRVADQGQAAAAATAEALRQAGPEWCEPAGLRRASGLSPRDTAHPTPYSDPQPHGHVPARK

SEQ ID NO: 71054 - protein, 556 aa, Homo sapiens
  Payload ID: 14085
  Gene Symbol: RAD21L1
  Gene Name: RAD21 cohesin complex component like 1
  Uniprot ID: Q9H4I0
  ENSP ID: ENSP00000386414
MFYTHVLMSKRGPLAKIWLAAHWEKKLTKAHVFECNLEITIEKILSPKVKIALRTSGHLLLGVVRIYNRKAKYLLADCSEAFLKMKMTFCPGLVDLPKENFEASYNAITLPEEFHDFDTQNMNAIDVSEHFTQNQSRPEEITLRENFDNDLIFQAESFGEESEILRRHSFFDDNILLNSSGPLIEHSSGSLTGERSLFYDSGDGFGDEGAAGEMIDNLLQDDQNILLEDMHLNREISLPSEPPNSLAVEPDNSECICVPENEKMNETILLSTEEEGFTLDPIDISDIAEKRKGKKRRLLIDPIKELSSKVIHKQLTSFADTLMVLELAPPTQRLMMWKKRGGVHTLLSTAAQDLIHAELKMLFTKCFLSSGFKLGRKMIQKESVREEVGNQNIVETSMMQEPNYQQELSKPQTWKDVIGGSQHSSHEDTNKNINSEQDIVEMVSLAAEESSLMNDLFAQEIEYSPVELESLSNEENIETERWNGRILQMLNRLRESNKMGMQSFSLMKLCRNSDRKQAAAKFYSFLVLKKQLAIELSQSAPYADIIATMGPMFYNI

SEQ ID NO: 71055 - protein, 362 aa, Homo sapiens
  Payload ID: 14086
  Gene Symbol: RAD23A
  Gene Name: RAD23 homolog A, nucleotide excision repair protein
  Uniprot ID: P54725
  ENSP ID: ENSP00000321365
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 71056 - protein, 62 aa, Homo sapiens
  Payload ID: 14086
  Gene Symbol: RAD23A
  Gene Name: RAD23 homolog A, nucleotide excision repair protein
  ENSP ID: ENSP00000466226
  MOD_RES (1)..(1): Any amino acid
XGSEYETMLTEIMSMGYERERVVAALRASYNNPHRAVEYLLTQERTPWSSCGTSPSSRTCGR

SEQ ID NO: 71057 - protein, 142 aa, Homo sapiens
  Payload ID: 14086
  Gene Symbol: RAD23A
  Gene Name: RAD23 homolog A, nucleotide excision repair protein
  ENSP ID: ENSP00000466243
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGDGL

SEQ ID NO: 71058 - protein, 139 aa, Homo sapiens
  Payload ID: 14086
  Gene Symbol: RAD23A
  Gene Name: RAD23 homolog A, nucleotide excision repair protein
  ENSP ID: ENSP00000466968
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSG

SEQ ID NO: 71059 - protein, 363 aa, Homo sapiens
  Payload ID: 14086
  Gene Symbol: RAD23A
  Gene Name: RAD23 homolog A, nucleotide excision repair protein
  Uniprot ID: P54725
  ENSP ID: ENSP00000467024
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 71060 - protein, 150 aa, Homo sapiens
  Payload ID: 14086
  Gene Symbol: RAD23A
  Gene Name: RAD23 homolog A, nucleotide excision repair protein
  ENSP ID: ENSP00000467628
IPGSPEPEHGSVQESQVSEQPATEAGENPLEFLRDQPQFQNMRQVIQQNPALLPALLQQLGQENPQLLQQISRHQEQFIQMLNEPPGELADISDVEGEVGAIGEEAPQMNYIQLKALGFPESLVIQAYFACEKNENLAANFLLSQNFDDE

SEQ ID NO: 71061 - protein, 308 aa, Homo sapiens
  Payload ID: 14086
  Gene Symbol: RAD23A
  Gene Name: RAD23 homolog A, nucleotide excision repair protein
  Uniprot ID: P54725
  ENSP ID: ENSP00000468674
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQLKALGFPESLVIQAYFACEKNENLAANFLLSQNFDDE

SEQ ID NO: 71062 - protein, 409 aa, Homo sapiens
  Payload ID: 14087
  Gene Symbol: RAD23B
  Gene Name: RAD23 homolog B, nucleotide excision repair protein
  Uniprot ID: P54727
  ENSP ID: ENSP00000350708
MQVTLKTLQQQTFKIDIDPEETVKALKEKIESEKGKDAFPVAGQKLIYAGKILNDDTALKEYKIDEKNFVVVMVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 71063 - protein, 114 aa, Homo sapiens
  Payload ID: 14087
  Gene Symbol: RAD23B
  Gene Name: RAD23 homolog B, nucleotide excision repair protein
  ENSP ID: ENSP00000396975
  MOD_RES (1)..(1): Any amino acid
XTASSEPAPASAAKQEKPAEKPAETPVATSPTATDSTSGDSSRSNLFEDATSALVTGQSYENMVTEIMSMGYEREQVIAALRASFNNPDRAVEYLLMIIVKTGNKKKKQPLLGK

SEQ ID NO: 71064 - protein, 337 aa, Homo sapiens
  Payload ID: 14087
  Gene Symbol: RAD23B
  Gene Name: RAD23 homolog B, nucleotide excision repair protein
  Uniprot ID: P54727
  ENSP ID: ENSP00000405623
MVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 71065 - protein, 80 aa, Homo sapiens
  Payload ID: 14087
  Gene Symbol: RAD23B
  Gene Name: RAD23 homolog B, nucleotide excision repair protein
  ENSP ID: ENSP00000415821
MVKALKEKIESEKGKDAFPVAGQKLIYAGKILNDDTALKEYKIDEKNFVVVMVTKPKAVSTPAPATTQQSAPASTTAVTS

SEQ ID NO: 71066 - protein, 146 aa, Homo sapiens
  Payload ID: 14087
  Gene Symbol: RAD23B
  Gene Name: RAD23 homolog B, nucleotide excision repair protein
  ENSP ID: ENSP00000416868
MQVTLKTLQQQTFKIDIDPEETVKALKEKIESEKGKDAFPVAGQKLIYAGKILNDDTALKEYKIDEKNFVVVMVTKPKAVSTPAPATTQQSAPASTTAVTSSTTTTVAQAPTPVPALAPTSTPASITPASATASSEPAPASAAKQE

SEQ ID NO: 71067 - protein, 1312 aa, Homo sapiens
  Payload ID: 14088
  Gene Symbol: RAD50
  Gene Name: RAD50 homolog, double strand break repair protein
  Uniprot ID: Q92878
  ENSP ID: ENSP00000368100
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 71068 - protein, 100 aa, Homo sapiens
  Payload ID: 14088
  Gene Symbol: RAD50
  Gene Name: RAD50 homolog, double strand break repair protein
  ENSP ID: ENSP00000389515
MVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQ

SEQ ID NO: 71069 - protein, 551 aa, Homo sapiens
  Payload ID: 14088
  Gene Symbol: RAD50
  Gene Name: RAD50 homolog, double strand break repair protein
  ENSP ID: ENSP00000390971
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKQGTSFI

SEQ ID NO: 71070 - protein, 158 aa, Homo sapiens
  Payload ID: 14088
  Gene Symbol: RAD50
  Gene Name: RAD50 homolog, double strand break repair protein
  ENSP ID: ENSP00000396100
  MOD_RES (1)..(1): Any amino acid
XEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLKIVLVKPHSITSCYNSLKKCFRNLIPLIEEVLLLSAADLEAVILGIHQVERLLNFNFSVRIV

SEQ ID NO: 71071 - protein, 157 aa, Homo sapiens
  Payload ID: 14088
  Gene Symbol: RAD50
  Gene Name: RAD50 homolog, double strand break repair protein
  ENSP ID: ENSP00000396860
  MOD_RES (1)..(1): Any amino acid
XIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEWSSRLRALSTERKFSTVHTHLWKALTT

SEQ ID NO: 71072 - protein, 660 aa, Homo sapiens
  Payload ID: 14088
  Gene Symbol: RAD50
  Gene Name: RAD50 homolog, double strand break repair protein
  ENSP ID: ENSP00000400049
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKK

SEQ ID NO: 71073 - protein, 102 aa, Homo sapiens
  Payload ID: 14088
  Gene Symbol: RAD50
  Gene Name: RAD50 homolog, double strand break repair protein
  ENSP ID: ENSP00000431225
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMAW

SEQ ID NO: 71074 - protein, 792 aa, Homo sapiens
  Payload ID: 14089
  Gene Symbol: RINT1
  Gene Name: RAD50 interactor 1
  Uniprot ID: Q6NUQ1
  ENSP ID: ENSP00000257700
MLPAGEIGASPAAPCCSESGDERKNLEEKSDINVTVLIGSKQVSEGTDNGDLPSYVSAFIEKEVGNDLKSLKKLDKLIEQRTVSKMQLEEQVLTISSEIPKRIRSALKNAEESKQFLNQFLEQETHLFSAINSHLLTAQPWMDDLGTMISQIEEIERHLAYLKWISQIEELSDNIQQYLMTNNVPEAASTLVSMAELDIKLQESSCTHLLGFMRATVKFWHKILKDKLTSDFEEILAQLHWPFIAPPQSQTVGLSRPASAPEIYSYLETLFCQLLKLQTSDELLTEPKQLPEKYSLPASPSVILPIQVMLTPLQKRFRYHFRGNRQTNVLSKPEWYLAQVLMWIGNHTEFLDEKIQPILDKVGSLVNARLEFSRGLMMLVLEKLATDIPCLLYDDNLFCHLVDEVLLFERELHSVHGYPGTFASCMHILSEETCFQRWLTVERKFALQKMDSMLSSEAAWVSQYKDITDVDEMKVPDCAETFMTLLLVITDRYKNLPTASRKLQFLELQKDLVDDFRIRLTQVMKEETRASLGFRYCAILNAVNYISTVLADWADNVFFLQLQQAALEVFAENNTLSKLQLGQLASMESSVFDDMINLLERLKHDMLTRQVDHVFREVKDAAKLYKKERWLSLPSQSEQAVMSLSSSACPLLLTLRDHLLQLEQQLCFSLFKIFWQMLVEKLDVYIYQEIILANHFNEGGAAQLQFDMTRNLFPLFSHYCKRPENYFKHIKEACIVLNLNVGSALLLKDVLQSASGQLPATAALNEVGIYKLAQQDVEILLNLRTNWPNTGK

SEQ ID NO: 71075 - protein, 41 aa, Homo sapiens
  Payload ID: 14089
  Gene Symbol: RINT1
  Gene Name: RAD50 interactor 1
  ENSP ID: ENSP00000417107
MLPAGEIGASPAAPCCSESGDERKNLEEKKMRSCSAVQAGM

SEQ ID NO: 71076 - protein, 143 aa, Homo sapiens
  Payload ID: 14089
  Gene Symbol: RINT1
  Gene Name: RAD50 interactor 1
  ENSP ID: ENSP00000417954
MLPAGEIGASPAAPCCSESGDERKNLEEKKKEVGNDLKSLKKLDKLIEQRTVSKMQLEEQVLTISSEIPKRIRSALKNAEESKQFLNQFLEQETHLFSAINSHLLTAQPWMDDLGTMISQIEEIERHLAYLKWISQIEELSDN

SEQ ID NO: 71077 - protein, 54 aa, Homo sapiens
  Payload ID: 14089
  Gene Symbol: RINT1
  Gene Name: RAD50 interactor 1
  ENSP ID: ENSP00000418805
MLPAGEIGASPAAPCCSESGDERKNLEEKSDINVTVLIGSKQVSEGTYNFIRNS

SEQ ID NO: 71078 - protein, 57 aa, Homo sapiens
  Payload ID: 14089
  Gene Symbol: RINT1
  Gene Name: RAD50 interactor 1
  ENSP ID: ENSP00000420582
MLPAGEIGASPAAPCCSESGDERKNLEEKSDINVTVLIGSKQVSEVSGAGNSSLQRH

SEQ ID NO: 71079 - protein, 352 aa, Homo sapiens
  Payload ID: 14090
  Gene Symbol: RAD51AP1
  Gene Name: RAD51 associated protein 1
  Uniprot ID: Q96B01
  ENSP ID: ENSP00000228843
MVRPVRHKKPVNYSQFDHSDSDDDFVSATVPLNKKSRTAPKELKQDKPKPNLNNLRKEEIPVQEKTPKKRLPEGTFSIPASAVPCTKMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALVTSVDSAPAAVKSESQSLPKKVSLSSDTTRKPLEIRSPSAESKKPKWVPPAASGGSRSSSSPLVVVSVKSPNQSLRLGLSRLARVKPLHPNATST

SEQ ID NO: 71080 - protein, 335 aa, Homo sapiens
  Payload ID: 14090
  Gene Symbol: RAD51AP1
  Gene Name: RAD51 associated protein 1
  Uniprot ID: Q96B01
  ENSP ID: ENSP00000309479
MVRPVRHKKPVNYSQFDHSDSDDDFVSATVPLNKKSRTAPKELKQDKPKPNLNNLRKEEIPVQEKTPKKRMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALVTSVDSAPAAVKSESQSLPKKVSLSSDTTRKPLEIRSPSAESKKPKWVPPAASGGSRSSSSPLVVVSVKSPNQSLRLGLSRLARVKPLHPNATST

SEQ ID NO: 71081 - protein, 70 aa, Homo sapiens
  Payload ID: 14090
  Gene Symbol: RAD51AP1
  Gene Name: RAD51 associated protein 1
  ENSP ID: ENSP00000399859
MVRPVRHKKPVNYSQFDHSDSDDDFVSATVPLNKKSRTAPKELKQDKPKPNLNNLRKEEIPVQEKTPKKR

SEQ ID NO: 71082 - protein, 71 aa, Homo sapiens
  Payload ID: 14090
  Gene Symbol: RAD51AP1
  Gene Name: RAD51 associated protein 1
  ENSP ID: ENSP00000438172
MVRPVRHKKPVNYSQFDHSDSDDDFVSATVPLNKKSRTAPKELKQDKPKPNLNNLRKEEIPVQEKTPKKRH

SEQ ID NO: 71083 - protein, 71 aa, Homo sapiens; identical to SEQ ID NO: 71082
  Payload ID: 14090
  Gene Symbol: RAD51AP1
  Gene Name: RAD51 associated protein 1
  ENSP ID: ENSP00000438422

SEQ ID NO: 71084 - protein, 68 aa, Homo sapiens
  Payload ID: 14090
  Gene Symbol: RAD51AP1
  Gene Name: RAD51 associated protein 1
  ENSP ID: ENSP00000439019
HKKPVNYSQFDHSDSDDDFVSATVPLNKKSRTAPKELKQDKPKPNLNNLRKEEIPVQEKTPKKSHRKK

SEQ ID NO: 71085 - protein, 70 aa, Homo sapiens; identical to SEQ ID NO: 71081
  Payload ID: 14090
  Gene Symbol: RAD51AP1
  Gene Name: RAD51 associated protein 1
  ENSP ID: ENSP00000439925

SEQ ID NO: 71086 - protein, 74 aa, Homo sapiens
  Payload ID: 14090
  Gene Symbol: RAD51AP1
  Gene Name: RAD51 associated protein 1
  ENSP ID: ENSP00000442890
MVRPVRHKKPVNYSQFDHSDSDDDFVSATVPLNKKSRTAPKELKQDKPKPNLNNLRKEEIPVQEKTPKKSHRKK

SEQ ID NO: 71087 - protein, 70 aa, Homo sapiens; identical to SEQ ID NO: 71081
  Payload ID: 14090
  Gene Symbol: RAD51AP1
  Gene Name: RAD51 associated protein 1
  ENSP ID: ENSP00000443837

SEQ ID NO: 71088 - protein, 258 aa, Homo sapiens
  Payload ID: 14090
  Gene Symbol: RAD51AP1
  Gene Name: RAD51 associated protein 1
  ENSP ID: ENSP00000444769
  MOD_RES (1)..(1): Any amino acid
XHKKPVNYSQFDHSDSDDDFVSATVPLNKKSRTAPKELKQDKPKPNLNNLRKEEIPVQEKTPKKRMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKVKSPVEKKEKKSKSKCNALDTTRKPLEIRSPSAESKKPKWVP

SEQ ID NO: 71089 - protein, 70 aa, Homo sapiens; identical to SEQ ID NO: 71081
  Payload ID: 14090
  Gene Symbol: RAD51AP1
  Gene Name: RAD51 associated protein 1
  ENSP ID: ENSP00000446002

SEQ ID NO: 71090 - protein, 235 aa, Homo sapiens
  Payload ID: 14090
  Gene Symbol: RAD51AP1
  Gene Name: RAD51 associated protein 1
  ENSP ID: ENSP00000446296
MVRPVRHKKPVNYSQFDHSDSDDDFVSATVPLNKKSRTAPKELKQDKPKPNLNNLRKEEIPVQEKTPKKRMALDDKLYQRDLEVALALSVKELPTVTTNVQNSQDKSIEKHGSSKIETMNKSPHISNCSVASDYLDLDKITVEDDVGGVQGKRKAASKAAAQQRKILLEGSDGDSANDTEPDFAPGEDSEDDSDFCESEDNDEDFSMRKSKVKEIKKKEVKRHLEVAEVAAAHWW

SEQ ID NO: 71091 - protein, 1159 aa, Homo sapiens
  Payload ID: 14091
  Gene Symbol: RAD51AP2
  Gene Name: RAD51 associated protein 2
  Uniprot ID: Q09MP3
  ENSP ID: ENSP00000382030
MSLPQPTPRMAELRKPTSSLTPPEDPDSQPPSSKRLCLEEPGGVFKAGWRLPLVPRLSEAEKVWELSPRPFKGLLVSTNAIFDNSTDSCVEKSVSGKQICNLKCSNLKFQMSSCLQSPPSQSPDSDLRASGRSEAGLHDREAFSVHRSNSSKAGVSQLLPSTSIHDIHGIRNENRKQQFVQGRDNVHKENPFLDVTFYKETKSPFHEIKNRCKANSVVPSNKRENNISSSVLKISKSQNQPSLEIAKPSYFRDSGTISVPQFPMDLNSKMSSVYLKEIAKKKNDKKEAYVRDFTNIYWSQNRPDVKKQKLQNDKKTVEAENIFSKCYENDYPSLSSQNTCKRKDLISSNYCNCSSIQCNVRDSRKNFAILENANWEEAECLDSYVLTRLEKSQNWDCNVRHILRRNRGNCWIINNCKTKCENMKKTEEKWNWLLLLEIDLLSKEDYHCAKVINAYEEQSKLLVREILGSQTALITTVWLNGKGENDNTLQLRYNTTQKVFHVNNPFESFIIEIFYFHKSISGNKKDNSILTCCNILKCKKQIGIIGIQNLITRNMNTNIKNGILSIYLQDSVSEPLDILLKTNIAFLLNNFDSLTRIENDFELEEECIFKCMLYLKYPKNIVENHTAYLVKILTSSRLLEDNMKPMLKKRKLFRTEQVFEKSKKKLINSFSMTTQNTGFPIFETYEKIPLLMDFDDMDEISLIREITCQNMSCPQQVVNVENWAHYNSSTVKAHGNSCPQFIQNNRGYINENFYEVNMHSQDLNMERKQGHNKISNFDCEHIFEDLCNVRQQAIPASHNIIHNEETHTTSITQVLNFWNLLSEIEEKKYDLILKEEVKVTAESLTNSCQVHKDTKIEKEEKDSFFPMDDMFSVQSVSLISKEVNVEENKYVNQNYVTNTNEYESILPEREIANSKDFHRKNDSALYINHQFETGLSEGNDECFQDLAAKYLSTEALTIVKDFEMKRKFDLVLEELRMFHEISRENELLSTVETNNGQENYFGENDAEKVKMEIEKDLKMVVVNKIRASSSFHDTIAGPNMGKSHQSLFKWKTVPNNGEQEVPNESCYPSRSEEELLYSTSEKDCETPLPKRPAFLPDECKEEFNYLLRGGSHFPHGISRVRPLKTCSRPIRIGLSRKARIKQLHPYLKQMCYGNLKENF

SEQ ID NO: 71092 - protein, 279 aa, Homo sapiens
  Payload ID: 14092
  Gene Symbol: RAD51B
  Gene Name: RAD51 paralog B
  ENSP ID: ENSP00000375101
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVSFSFFLFFLFLSFVSFILHSLTYGIK

SEQ ID NO: 71093 - protein, 108 aa, Homo sapiens
  Payload ID: 14092
  Gene Symbol: RAD51B
  Gene Name: RAD51 paralog B
  ENSP ID: ENSP00000417408
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEDGT

SEQ ID NO: 71094 - protein, 133 aa, Homo sapiens
  Payload ID: 14092
  Gene Symbol: RAD51B
  Gene Name: RAD51 paralog B
  ENSP ID: ENSP00000417948
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGG

SEQ ID NO: 71095 - protein, 350 aa, Homo sapiens
  Payload ID: 14092
  Gene Symbol: RAD51B
  Gene Name: RAD51 paralog B
  Uniprot ID: O15315
  ENSP ID: ENSP00000418859
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQGQEKP

SEQ ID NO: 71096 - protein, 384 aa, Homo sapiens
  Payload ID: 14092
  Gene Symbol: RAD51B
  Gene Name: RAD51 paralog B
  Uniprot ID: O15315
  ENSP ID: ENSP00000419471
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQETTFCSVTQAELNWAPEILPPQPPEQLGLQMCHHTQLIF

SEQ ID NO: 71097 - protein, 425 aa, Homo sapiens
  Payload ID: 14092
  Gene Symbol: RAD51B
  Gene Name: RAD51 paralog B
  ENSP ID: ENSP00000419881
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQVVRTVARVSPRSECWSAADSHPSPTFLIPDVVLRKTRNPRLLPSVSMCPPQMHSTVLSSALPPTNWATGIRTETLDEHPV

SEQ ID NO: 71098 - protein, 366 aa, Homo sapiens
  Payload ID: 14092
  Gene Symbol: RAD51B
  Gene Name: RAD51 paralog B
  Uniprot ID: O15315
  ENSP ID: ENSP00000420061
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQEFWHICISGFSIQNRLKENES

SEQ ID NO: 71099 - protein, 35 aa, Homo sapiens
  Payload ID: 14092
  Gene Symbol: RAD51B
  Gene Name: RAD51 paralog B
  ENSP ID: ENSP00000451616
DSERRQILIAKSPLAPFTSFVYTIKEEGLVLQAGK

SEQ ID NO: 71100 - protein, 75 aa, Homo sapiens
  Payload ID: 14092
  Gene Symbol: RAD51B
  Gene Name: RAD51 paralog B
  ENSP ID: ENSP00000452044
MGSKKLKRVGLSQELCDRLSRHQILTCQDFLCLSPLELMKVTGLSYRGVHELLCMVSRACAPKMQTAYGIKAQRS

SEQ ID NO: 71101 - protein, 376 aa, Homo sapiens
  Payload ID: 14093
  Gene Symbol: RAD51C
  Gene Name: RAD51 paralog C
  Uniprot ID: O43502
  ENSP ID: ENSP00000336701
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQRLATLYKSPSQKECTVLFQIKPQGFRDTVVTSACSLQTEGSLSTRKRSRDPEEEL

SEQ ID NO: 71102 - protein, 135 aa, Homo sapiens
  Payload ID: 14093
  Gene Symbol: RAD51C
  Gene Name: RAD51 paralog C
  Uniprot ID: O43502
  ENSP ID: ENSP00000391450
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLW

SEQ ID NO: 71103 - protein, 257 aa, Homo sapiens
  Payload ID: 14093
  Gene Symbol: RAD51C
  Gene Name: RAD51 paralog C
  ENSP ID: ENSP00000401741
  MOD_RES (1)..(1): Any amino acid
XEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQSRLATLYKSPSQKECTVLFQIKPQGFRDTVVTSACSLQTEGSLSTRKRSRDPEEEL

SEQ ID NO: 71104 - protein, 213 aa, Homo sapiens
  Payload ID: 14093
  Gene Symbol: RAD51C
  Gene Name: RAD51 paralog C
  ENSP ID: ENSP00000407282
LTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKAHCSSRITLLLCGVALPLPLSARAPPSETKDDIALPPGLMVRLVIV

SEQ ID NO: 71105 - protein, 134 aa, Homo sapiens
  Payload ID: 14093
  Gene Symbol: RAD51C
  Gene Name: RAD51 paralog C
  ENSP ID: ENSP00000431637
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQL

SEQ ID NO: 71106 - protein, 52 aa, Homo sapiens
  Payload ID: 14093
  Gene Symbol: RAD51C
  Gene Name: RAD51 paralog C
  ENSP ID: ENSP00000432421
MRGKTFRFEMQRDLVSFPLSPAVRVKLVSAGFQTAEELLEVKPSELSKGNDS

SEQ ID NO: 71107 - protein, 134 aa, Homo sapiens; identical to SEQ ID NO: 71105
  Payload ID: 14093
  Gene Symbol: RAD51C
  Gene Name: RAD51 paralog C
  ENSP ID: ENSP00000433332

SEQ ID NO: 71108 - protein, 52 aa, Homo sapiens; identical to SEQ ID NO: 71106
  Payload ID: 14093
  Gene Symbol: RAD51C
  Gene Name: RAD51 paralog C
  ENSP ID: ENSP00000436761

SEQ ID NO: 71109 - protein, 346 aa, Homo sapiens
  Payload ID: 14093
  Gene Symbol: RAD51C
  Gene Name: RAD51 paralog C
  ENSP ID: ENSP00000463121
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQRLATLYKSPSQKECTVLFQIKVSII

SEQ ID NO: 71110 - protein, 47 aa, Homo sapiens
  Payload ID: 14093
  Gene Symbol: RAD51C
  Gene Name: RAD51 paralog C
  ENSP ID: ENSP00000463473
  MOD_RES (1)..(1): Any amino acid
XFEMQRDLVSFPLSPAVRVKLVSAGFQTAEELLEVKPSELSKVCSWQ

SEQ ID NO: 71111 - protein, 107 aa, Homo sapiens
  Payload ID: 14093
  Gene Symbol: RAD51C
  Gene Name: RAD51 paralog C
  ENSP ID: ENSP00000463658
VRLVIVDGIAFPFRHDLDDLSLRTRLLNGLAQQMISLANNHRLAVILTNQMTTKIDRNQALLVPALGWQHCTSHPARRNAQYCFKSNLRDLEILLLLLHVHCKQKVP

SEQ ID NO: 71112 - protein, 135 aa, Homo sapiens
  Payload ID: 14093
  Gene Symbol: RAD51C
  Gene Name: RAD51 paralog C
  ENSP ID: ENSP00000464056
MKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDL

SEQ ID NO: 71113 - protein, 131 aa, Homo sapiens
  Payload ID: 14093
  Gene Symbol: RAD51C
  Gene Name: RAD51 paralog C
  ENSP ID: ENSP00000482326
ELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEESGSTARAGVQWRNLGLLRPSPPRFKRFS

SEQ ID NO: 71114 - protein, 216 aa, Homo sapiens
  Payload ID: 14094
  Gene Symbol: RAD51D
  Gene Name: RAD51 paralog D
  Uniprot ID: O75771
  ENSP ID: ENSP00000338408
MGVLRVGLCPGLTEEMIQLLRSHRIKTVVDLVSADLEEVAQKCGLSYKAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 71115 - protein, 328 aa, Homo sapiens
  Payload ID: 14094
  Gene Symbol: RAD51D
  Gene Name: RAD51 paralog D
  Uniprot ID: O75771
  ENSP ID: ENSP00000338790
MGVLRVGLCPGLTEEMIQLLRSHRIKTVVDLVSADLEEVAQKCGLSYKALVALRRVLLAQFSAFPVNGADLYEELKTSTAILSTGIGSLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 71116 - protein, 328 aa, Homo sapiens; identical to SEQ ID NO: 71115
  Payload ID: 14094
  Gene Symbol: RAD51D
  Gene Name: RAD51 paralog D
  Uniprot ID: O75771
  ENSP ID: ENSP00000378090

SEQ ID NO: 71117 - protein, 151 aa, Homo sapiens
  Payload ID: 14094
  Gene Symbol: RAD51D
  Gene Name: RAD51 paralog D
  ENSP ID: ENSP00000464356
MLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 71118 - protein, 86 aa, Homo sapiens
  Payload ID: 14094
  Gene Symbol: RAD51D
  Gene Name: RAD51 paralog D
  ENSP ID: ENSP00000465007
  MOD_RES (1)..(1): Any amino acid
XADLEEVAQKCGLSYKALVALRRVLLAQFSAFPVNGADLYEELKTSTAILSTGIGRHGGRTQVGTWEDCSCLRSPQGDRGVGSGML

SEQ ID NO: 71119 - protein, 24 aa, Homo sapiens
  Payload ID: 14094
  Gene Symbol: RAD51D
  Gene Name: RAD51 paralog D
  ENSP ID: ENSP00000465033
MLDVLQELRGTVAQQVTGSSGTVK

SEQ ID NO: 71120 - protein, 49 aa, Homo sapiens
  Payload ID: 14094
  Gene Symbol: RAD51D
  Gene Name: RAD51 paralog D
  Uniprot ID: O75771
  ENSP ID: ENSP00000465366
MGVLRVGLCPGLTEEMIQLLRSHRIKTVVDLVSADLEEVAQKCGLSYKS

SEQ ID NO: 71121 - protein, 49 aa, Homo sapiens; identical to SEQ ID NO: 71120
  Payload ID: 14094
  Gene Symbol: RAD51D
  Gene Name: RAD51 paralog D
  Uniprot ID: O75771
  ENSP ID: ENSP00000465584

SEQ ID NO: 71122 - protein, 107 aa, Homo sapiens
  Payload ID: 14094
  Gene Symbol: RAD51D
  Gene Name: RAD51 paralog D
  ENSP ID: ENSP00000465612
MGVLRVGLCPGLTEEMIQLLRSHRIKTVVDLVSADLEEVAQKCGLSYKALVALRRVLLAQFSAFPVNGADLYEELKTSTAILSTGIGRYVSVWQQMWPMACSKTSYM

SEQ ID NO: 71123 - protein, 348 aa, Homo sapiens
  Payload ID: 14094
  Gene Symbol: RAD51D
  Gene Name: RAD51 paralog D
  Uniprot ID: O75771
  ENSP ID: ENSP00000466399
MGVLRVGLCPGLTEEMIQLLRSHRIKTVVDLVSADLEEVAQKCGLSYKTWRAHSSGNLGGLQLPQVPAGRSWSGVRNALKKAGLGHGGTDGLSLNAFDERGTAVSTSRLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 71124 - protein, 141 aa, Homo sapiens
  Payload ID: 14094
  Gene Symbol: RAD51D
  Gene Name: RAD51 paralog D
  ENSP ID: ENSP00000466478
MAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRL

SEQ ID NO: 71125 - protein, 118 aa, Homo sapiens
  Payload ID: 14094
  Gene Symbol: RAD51D
  Gene Name: RAD51 paralog D
  Uniprot ID: O75771
  ENSP ID: ENSP00000466587
MGVLRVGLCPGLTEEMIQLLRSHRIKTVVDLVSADLEEVAQKCGLSYKALVALRRVLLAQFSAFPVNGADLYEELKTSTAILSTGIGRHGGRTQVGTWEDCSCLRSPQGDRGVGSGML

SEQ ID NO: 71126 - protein, 249 aa, Homo sapiens
  Payload ID: 14094
  Gene Symbol: RAD51D
  Gene Name: RAD51 paralog D
  ENSP ID: ENSP00000466839
MTPSPTLGAASSSLLSPPAASAPVSSLGRVVDLVSADLEEVAQKCGLSYKALVALRRVLLAQFSAFPVNGADLYEELKTSTAILSTGIGSLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVV

SEQ ID NO: 71127 - protein, 96 aa, Homo sapiens
  Payload ID: 14094
  Gene Symbol: RAD51D
  Gene Name: RAD51 paralog D
  ENSP ID: ENSP00000468273
  MOD_RES (1)..(1): Any amino acid
XADLEEVAQKCGLSYKALVALRRVLLAQFSAFPVNGADLYEELKTSTAILSTGIGSLDKLLDAGLYTGEVTEIVGGPGSGKTQAEALRRIQVVHAF

SEQ ID NO: 71128 - protein, 86 aa, Homo sapiens; identical to SEQ ID NO: 71118
  Payload ID: 14094
  Gene Symbol: RAD51D
  Gene Name: RAD51 paralog D
  ENSP ID: ENSP00000468724
  MOD_RES (1)..(1): Any amino acid

SEQ ID NO: 71129 - protein, 93 aa, Homo sapiens
  Payload ID: 14094
  Gene Symbol: RAD51D
  Gene Name: RAD51 paralog D
  ENSP ID: ENSP00000468764
MAANVAHGLQQNVLYVDSNGGLTASRLLQLLQAKTQDEEEQAEALRRIQVVHAFDIFQMLDVLQELRGTVAQQDGIPEHLNHIPHCLHVHLPC

SEQ ID NO: 71130 - protein, 339 aa, Homo sapiens
  Payload ID: 14095
  Gene Symbol: RAD51
  Gene Name: RAD51 recombinase
  Uniprot ID: Q06609
  ENSP ID: ENSP00000267868
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 71131 - protein, 340 aa, Homo sapiens
  Payload ID: 14095
  Gene Symbol: RAD51
  Gene Name: RAD51 recombinase
  Uniprot ID: Q06609
  ENSP ID: ENSP00000372088
MAMQMQLEANADTSVEEESFGPQPISRLEQCGINANDVKKLEEAGFHTVEAVAYAPKKELINIKGISEAKADKILTESRSVARLECNSVILVYCTLRLSGSSDSPASASRVVGTTGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 71132 - protein, 280 aa, Homo sapiens
  Payload ID: 14095
  Gene Symbol: RAD51
  Gene Name: RAD51 recombinase
  Uniprot ID: Q06609
  ENSP ID: ENSP00000406602
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEIVSEERKRGNQNLQNLRLSLSS

SEQ ID NO: 71133 - protein, 151 aa, Homo sapiens
  Payload ID: 14095
  Gene Symbol: RAD51
  Gene Name: RAD51 recombinase
  ENSP ID: ENSP00000431864
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQVWSLWQ

SEQ ID NO: 71134 - protein, 75 aa, Homo sapiens
  Payload ID: 14095
  Gene Symbol: RAD51
  Gene Name: RAD51 recombinase
  ENSP ID: ENSP00000431897
MAMQMQLEANADTSVEEESFGPQPISRLEQCGINANDVKKLEEAGFHTVEAVAYAPKKELINIKGISEAKADKIL

SEQ ID NO: 71135 - protein, 172 aa, Homo sapiens
  Payload ID: 14095
  Gene Symbol: RAD51
  Gene Name: RAD51 recombinase
  ENSP ID: ENSP00000432759
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLL

SEQ ID NO: 71136 - protein, 65 aa, Homo sapiens
  Payload ID: 14095
  Gene Symbol: RAD51
  Gene Name: RAD51 recombinase
  ENSP ID: ENSP00000433053
  MOD_RES (1)..(1): Any amino acid
XAYAPKKELINIKGISEAKADKILTESRSVARLECNSVILVYCTLRLSGSSDSPASASRVVGTTG

SEQ ID NO: 71137 - protein, 340 aa, Homo sapiens; identical to SEQ ID NO: 71131
  Payload ID: 14095
  Gene Symbol: RAD51
  Gene Name: RAD51 recombinase
  Uniprot ID: Q06609
  ENSP ID: ENSP00000433924

SEQ ID NO: 71138 - protein, 100 aa, Homo sapiens
  Payload ID: 14095
  Gene Symbol: RAD51
  Gene Name: RAD51 recombinase
  ENSP ID: ENSP00000436512
MAMQMQLEANADTSVEEESFGPQPISRLEQCGINANDVKKLEEAGFHTVEAVAYAPKKELINIKGISEAKADKILVELRLDLSQKCLENSELGRPRSVIR

SEQ ID NO: 71139 - protein, 242 aa, Homo sapiens
  Payload ID: 14095
  Gene Symbol: RAD51
  Gene Name: RAD51 recombinase
  Uniprot ID: Q06609
  ENSP ID: ENSP00000454176
MAMQMQLEANADTSVEEESFGPQPISRLEQCGINANDVKKLEEAGFHTVEAVAYAPKKELINIKGISEAKADKILAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 71140 - protein, 204 aa, Homo sapiens
  Payload ID: 14096
  Gene Symbol:
  Gene Name: RAD51L3-RFFL
  ENSP ID: ENSP00000464799
MAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQILSCGQPAATGSAWMDSLRRSH

SEQ ID NO: 71141 - protein, 272 aa, Homo sapiens
  Payload ID: 14096
  Gene Symbol:
  Gene Name: RAD51L3-RFFL
  ENSP ID: ENSP00000466834
MAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQSIDSEDSFVPGRRASLSDLTDLEDIEGLTVRQLKEILARNFVNYKGCCEKWELMERVTRLYKDQKGLQHLGGAVPSGLEENLCKICMDSPIDCVLLECGHMVTCTKCGKRMNECPICRQYVIRAVHVFRS

SEQ ID NO: 71142 - protein, 128 aa, Homo sapiens
  Payload ID: 14096
  Gene Symbol:
  Gene Name: RAD51L3-RFFL
  ENSP ID: ENSP00000467986
MLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQSIDS

SEQ ID NO: 71143 - protein, 418 aa, Homo sapiens
  Payload ID: 14097
  Gene Symbol: RAD52
  Gene Name: RAD52 homolog, DNA repair protein
  Uniprot ID: P43351
  ENSP ID: ENSP00000351284
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRSFGNALGNCILDKDYLRSLNKLPRQLPLEVDLTKAKRQDLEPSVEEARYNSCRPNMALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 71144 - protein, 131 aa, Homo sapiens
  Payload ID: 14097
  Gene Symbol: RAD52
  Gene Name: RAD52 homolog, DNA repair protein
  ENSP ID: ENSP00000380407
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKVRGWSRPAARKDQWV

SEQ ID NO: 71145 - protein, 418 aa, Homo sapiens; identical to SEQ ID NO: 71143
  Payload ID: 14097
  Gene Symbol: RAD52
  Gene Name: RAD52 homolog, DNA repair protein
  Uniprot ID: P43351
  ENSP ID: ENSP00000387901

SEQ ID NO: 71146 - protein, 139 aa, Homo sapiens
  Payload ID: 14097
  Gene Symbol: RAD52
  Gene Name: RAD52 homolog, DNA repair protein
  Uniprot ID: P43351
  ENSP ID: ENSP00000434703
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKVRGWSRPAARKDQWVVGEGWFIS

SEQ ID NO: 71147 - protein, 139 aa, Homo sapiens; identical to SEQ ID NO: 71146
  Payload ID: 14097
  Gene Symbol: RAD52
  Gene Name: RAD52 homolog, DNA repair protein
  Uniprot ID: P43351
  ENSP ID: ENSP00000436008

SEQ ID NO: 71148 - protein, 118 aa, Homo sapiens
  Payload ID: 14097
  Gene Symbol: RAD52
  Gene Name: RAD52 homolog, DNA repair protein
  Uniprot ID: P43351
  ENSP ID: ENSP00000438965
MSGTEEAILGGRDSHPAAGGGSVLCFGQCQYTAEEYQAIQKALRQRLGPEYISSRMAGGGQKVCYIEGHRVINLANEMFGYNGWAHSITQQNVGEYALQQWGLLHCPAPAESLLWVRR

SEQ ID NO: 71149 - protein, 99 aa, Homo sapiens
  Payload ID: 14097
  Gene Symbol: RAD52
  Gene Name: RAD52 homolog, DNA repair protein
  ENSP ID: ENSP00000439583
MSGTEEAILGGRDSHPAAGGGSVLCFGQCQYTAEEYQAIQKALRQRLGPEYISSRMAGGGQKVCYIEGHRVINLANEMFGYNGWAHSITQQNVGFPCWE

SEQ ID NO: 71150 - protein, 226 aa, Homo sapiens
  Payload ID: 14097
  Gene Symbol: RAD52
  Gene Name: RAD52 homolog, DNA repair protein
  Uniprot ID: P43351
  ENSP ID: ENSP00000440268
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRLPLLGVSGRILYSLFSVHSVMCAGGLPTPTASAQTAPSSPCSSAVLRYAQEFWECTWKLYSGQRLPEITK

SEQ ID NO: 71151 - protein, 301 aa, Homo sapiens
  Payload ID: 14097
  Gene Symbol: RAD52
  Gene Name: RAD52 homolog, DNA repair protein
  ENSP ID: ENSP00000440486
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRSFGNALGNCILDKDYLRSLNKLPRQLPLEVDLTKAKRQDLEPSVEEARYNSCRPNMALGHPQLQQVTSPSRPSHAVIPADQDCSSRSRGCCSGARPRRRPLMQKPELIRRGERGHAPAEAPAEAAAAAVPGADGEAAGSSLHAVS

SEQ ID NO: 71152 - protein, 129 aa, Homo sapiens
  Payload ID: 14097
  Gene Symbol: RAD52
  Gene Name: RAD52 homolog, DNA repair protein
  ENSP ID: ENSP00000441073
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVS

SEQ ID NO: 71153 - protein, 118 aa, Homo sapiens; identical to SEQ ID NO: 71148
  Payload ID: 14097
  Gene Symbol: RAD52
  Gene Name: RAD52 homolog, DNA repair protein
  Uniprot ID: P43351
  ENSP ID: ENSP00000443254

SEQ ID NO: 71154 - protein, 120 aa, Homo sapiens
  Payload ID: 14097
  Gene Symbol: RAD52
  Gene Name: RAD52 homolog, DNA repair protein
  ENSP ID: ENSP00000445245
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKVRME

SEQ ID NO: 71155 - protein, 137 aa, Homo sapiens
  Payload ID: 14098
  Gene Symbol: RDM1
  Gene Name: RAD52 motif containing 1
  Uniprot ID: Q8NG50
  ENSP ID: ENSP00000477869
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKKVVK

SEQ ID NO: 71156 - protein, 114 aa, Homo sapiens
  Payload ID: 14098
  Gene Symbol: RDM1
  Gene Name: RAD52 motif containing 1
  Uniprot ID: Q8NG50
  ENSP ID: ENSP00000477995
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKKVVK

SEQ ID NO: 71157 - protein, 79 aa, Homo sapiens
  Payload ID: 14098
  Gene Symbol: RDM1
  Gene Name: RAD52 motif containing 1
  Uniprot ID: Q8NG50
  ENSP ID: ENSP00000478131
MAELVPFAVPIESDKTLLVWELSSGPTAEALHVRLGTRHKAVQHQALALNSSKCQELANYYFGFNGCSKRIIKDHYHSL

SEQ ID NO: 71158 - protein, 166 aa, Homo sapiens
  Payload ID: 14098
  Gene Symbol: RDM1
  Gene Name: RAD52 motif containing 1
  Uniprot ID: Q8NG50
  ENSP ID: ENSP00000478597
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKVPCSPWKQYGQEEEGYLSDFSLEEEEFRLPELD

SEQ ID NO: 71159 - protein, 251 aa, Homo sapiens
  Payload ID: 14098
  Gene Symbol: RDM1
  Gene Name: RAD52 motif containing 1
  Uniprot ID: Q8NG50
  ENSP ID: ENSP00000478915
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEESGKIAVEYRPSEDIVGVRCEEELHGLIQVPCSPWKQYGQEEEGYLSDFSLEEEEFRLPELD

SEQ ID NO: 71160 - protein, 261 aa, Homo sapiens
  Payload ID: 14098
  Gene Symbol: RDM1
  Gene Name: RAD52 motif containing 1
  Uniprot ID: Q8NG50
  ENSP ID: ENSP00000479310
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLESGKIAVEYRPSEDIVGVRCEEELHGLIQVPCSPWKQYGQEEEGYLSDFSLEEEEFRLPELD

SEQ ID NO: 71161 - protein, 143 aa, Homo sapiens
  Payload ID: 14098
  Gene Symbol: RDM1
  Gene Name: RAD52 motif containing 1
  Uniprot ID: Q8NG50
  ENSP ID: ENSP00000479622
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKVPCSPWKQYGQEEEGYLSDFSLEEEEFRLPELD

SEQ ID NO: 71162 - protein, 116 aa, Homo sapiens
  Payload ID: 14098
  Gene Symbol: RDM1
  Gene Name: RAD52 motif containing 1
  Uniprot ID: Q8NG50
  ENSP ID: ENSP00000480131
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKDHYHSL

SEQ ID NO: 71163 - protein, 284 aa, Homo sapiens
  Payload ID: 14098
  Gene Symbol: RDM1
  Gene Name: RAD52 motif containing 1
  Uniprot ID: Q8NG50
  ENSP ID: ENSP00000481061
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLESGKIAVEYRPSEDIVGVRCEEELHGLIQVPCSPWKQYGQEEEGYLSDFSLEEEEFRLPELD

SEQ ID NO: 71164 - protein, 116 aa, Homo sapiens; identical to SEQ ID NO: 71162
  Payload ID: 14098
  Gene Symbol: RDM1
  Gene Name: RAD52 motif containing 1
  Uniprot ID: Q8NG50
  ENSP ID: ENSP00000481648

SEQ ID NO: 71165 - protein, 116 aa, Homo sapiens; identical to SEQ ID NO: 71162
  Payload ID: 14098
  Gene Symbol: RDM1
  Gene Name: RAD52 motif containing 1
  Uniprot ID: Q8NG50
  ENSP ID: ENSP00000481726

SEQ ID NO: 71166 - protein, 236 aa, Homo sapiens
  Payload ID: 14098
  Gene Symbol: RDM1
  Gene Name: RAD52 motif containing 1
  Uniprot ID: Q8NG50
  ENSP ID: ENSP00000482288
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLGKTVLIILEVLQFQ

SEQ ID NO: 71167 - protein, 139 aa, Homo sapiens
  Payload ID: 14098
  Gene Symbol: RDM1
  Gene Name: RAD52 motif containing 1
  Uniprot ID: Q8NG50
  ENSP ID: ENSP00000482981
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKDHYHSL

SEQ ID NO: 71168 - protein, 166 aa, Homo sapiens; identical to SEQ ID NO: 71158
  Payload ID: 14098
  Gene Symbol: RDM1
  Gene Name: RAD52 motif containing 1
  Uniprot ID: Q8NG50
  ENSP ID: ENSP00000483387

SEQ ID NO: 71169 - protein, 284 aa, Homo sapiens; identical to SEQ ID NO: 71163
  Payload ID: 14098
  Gene Symbol: RDM1
  Gene Name: RAD52 motif containing 1
  Uniprot ID: Q8NG50
  ENSP ID: ENSP00000483549

SEQ ID NO: 71170 - protein, 251 aa, Homo sapiens; identical to SEQ ID NO: 71159
  Payload ID: 14098
  Gene Symbol: RDM1
  Gene Name: RAD52 motif containing 1
  Uniprot ID: Q8NG50
  ENSP ID: ENSP00000483566

SEQ ID NO: 71171 - protein, 213 aa, Homo sapiens
  Payload ID: 14098
  Gene Symbol: RDM1
  Gene Name: RAD52 motif containing 1
  ENSP ID: ENSP00000483890
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLGKTVLIILEVLQFQ

SEQ ID NO: 71172 - protein, 228 aa, Homo sapiens
  Payload ID: 14098
  Gene Symbol: RDM1
  Gene Name: RAD52 motif containing 1
  Uniprot ID: Q8NG50
  ENSP ID: ENSP00000483933
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEESGKIAVEYRPSEDIVGVRCEEELHGLIQVPCSPWKQYGQEEEGYLSDFSLEEEEFRLPELD

SEQ ID NO: 71173 - protein, 139 aa, Homo sapiens; identical to SEQ ID NO: 71167
  Payload ID: 14098
  Gene Symbol: RDM1
  Gene Name: RAD52 motif containing 1
  Uniprot ID: Q8NG50
  ENSP ID: ENSP00000487602

SEQ ID NO: 71174 - protein, 116 aa, Homo sapiens; identical to SEQ ID NO: 71162
  Payload ID: 14098
  Gene Symbol: RDM1
  Gene Name: RAD52 motif containing 1
  Uniprot ID: Q8NG50
  ENSP ID: ENSP00000487670

SEQ ID NO: 71175 - protein, 79 aa, Homo sapiens; identical to SEQ ID NO: 71157
  Payload ID: 14098
  Gene Symbol: RDM1
  Gene Name: RAD52 motif containing 1
  Uniprot ID: Q8NG50
  ENSP ID: ENSP00000487863

SEQ ID NO: 71176 - protein, 236 aa, Homo sapiens; identical to SEQ ID NO: 71166
  Payload ID: 14098
  Gene Symbol: RDM1
  Gene Name: RAD52 motif containing 1
  Uniprot ID: Q8NG50
  ENSP ID: ENSP00000487935

SEQ ID NO: 71177 - protein, 114 aa, Homo sapiens; identical to SEQ ID NO: 71156
  Payload ID: 14098
  Gene Symbol: RDM1
  Gene Name: RAD52 motif containing 1
  Uniprot ID: Q8NG50
  ENSP ID: ENSP00000488160

SEQ ID NO: 71178 - protein, 213 aa, Homo sapiens; identical to SEQ ID NO: 71171
  Payload ID: 14098
  Gene Symbol: RDM1
  Gene Name: RAD52 motif containing 1
  ENSP ID: ENSP00000488202

SEQ ID NO: 71179 - protein, 137 aa, Homo sapiens; identical to SEQ ID NO: 71155
  Payload ID: 14098
  Gene Symbol: RDM1
  Gene Name: RAD52 motif containing 1
  Uniprot ID: Q8NG50
  ENSP ID: ENSP00000488583

SEQ ID NO: 71180 - protein, 228 aa, Homo sapiens; identical to SEQ ID NO: 71172
  Payload ID: 14098
  Gene Symbol: RDM1
  Gene Name: RAD52 motif containing 1
  Uniprot ID: Q8NG50
  ENSP ID: ENSP00000488617

SEQ ID NO: 71181 - protein, 143 aa, Homo sapiens; identical to SEQ ID NO: 71161
  Payload ID: 14098
  Gene Symbol: RDM1
  Gene Name: RAD52 motif containing 1
  Uniprot ID: Q8NG50
  ENSP ID: ENSP00000488806

SEQ ID NO: 71182 - protein, 261 aa, Homo sapiens; identical to SEQ ID NO: 71160
  Payload ID: 14098
  Gene Symbol: RDM1
  Gene Name: RAD52 motif containing 1
  Uniprot ID: Q8NG50
  ENSP ID: ENSP00000488876

SEQ ID NO: 71183 - protein, 910 aa, Homo sapiens
  Payload ID: 14099
  Gene Symbol: RAD54B
  Gene Name: RAD54 homolog B (S. cerevisiae)
  Uniprot ID: Q9Y620
  ENSP ID: ENSP00000336606
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVHSAPKEVAVSKEQEEKSDSLVKYFSVVWCKPSKKKHKKWEGDAVLIVKGKSFILKNLEGKDIGRGIGYKFKELEKIEEGQTLMICGKEIEVMGVISPDDFSSGRCFQLGGGSTAISHSSQVARKCFSNPFKSVCKPSSKENRQNDFQNCKPRHDPYTPNSLVMPRPDKNHQWVFNKNCFPLVDVVIDPYLVYHLRPHQKEGIIFLYECVMGMRMNGRCGAILADEMGLGKTLQCISLIWTLQCQGPYGGKPVIKKTLIVTPGSLVNNWKKEFQKWLGSERIKIFTVDQDHKVEEFIKSIFYSVLIISYEMLLRSLDQIKNIKFDLLICDEGHRLKNSAIKTTTALISLSCEKRIILTGTPIQNDLQEFFALIDFVNPGILGSLSSYRKIYEEPIILSREPSASEEEKELGERRAAELTCLTGLFILRRTQEIINKYLPPKIENVVFCRPGALQIELYRKLLNSQVVRFCLQGLLENSPHLICIGALKKLCNHPCLLFNSIKEKECSSTCDKNEEKSLYKGLLSVFPADYNPLLFTEKESGKLQVLSKLLAVIHELRPTEKVVLVSNYTQTLNILQEVCKRHGYAYTRLDGQTPISQRQQIVDGFNSQHSSFFIFLLSSKAGGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 71184 - protein, 125 aa, Homo sapiens
  Payload ID: 14099
  Gene Symbol: RAD54B
  Gene Name: RAD54 homolog B (S. cerevisiae)
  ENSP ID: ENSP00000428554
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVHSAPKEVAVSKEQEEKSDSLVKY

SEQ ID NO: 71185 - protein, 117 aa, Homo sapiens
  Payload ID: 14099
  Gene Symbol: RAD54B
  Gene Name: RAD54 homolog B (S. cerevisiae)
  Uniprot ID: Q9Y620
  ENSP ID: ENSP00000430153
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVQTWMRRHRLVPVHYR

SEQ ID NO: 71186 - protein, 52 aa, Homo sapiens
  Payload ID: 14099
  Gene Symbol: RAD54B
  Gene Name: RAD54 homolog B (S. cerevisiae)
  ENSP ID: ENSP00000430570
MRRSAAPSQLQGNSFKKPKFIPPGRSNPGLNEEITKLNPDIKLFEFIRLLKK

SEQ ID NO: 71187 - protein, 121 aa, Homo sapiens
  Payload ID: 14099
  Gene Symbol: RAD54B
  Gene Name: RAD54 homolog B (S. cerevisiae)
  ENSP ID: ENSP00000430808
MRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVQTWMRRHRLVPVHYSSFGS

SEQ ID NO: 71188 - protein, 726 aa, Homo sapiens
  Payload ID: 14099
  Gene Symbol: RAD54B
  Gene Name: RAD54 homolog B (S. cerevisiae)
  ENSP ID: ENSP00000483397
MICGKEIEVMGVISPDDFSSGRCFQLGGGSTAISHSSQVARKCFSNPFKSVCKPSSKENRQNDFQNCKPRHDPYTPNSLVMPRPDKNHQWVFNKNCFPLVDVVIDPYLVYHLRPHQKEGIIFLYECVMGMRMNGRCGAILADEMGLGKTLQCISLIWTLQCQGPYGGKPVIKKTLIVTPGSLVNNWKKEFQKWLGSERIKIFTVDQDHKVEEFIKSIFYSVLIISYEMLLRSLDQIKNIKFDLLICDEGHRLKNSAIKTTTALISLSCEKRIILTGTPIQNDLQEFFALIDFVNPGILGSLSSYRKIYEEPIILSREPSASEEEKELGERRAAELTCLTGLFILRRTQEIINKYLPPKIENVVFCRPGALQIELYRKLLNSQVVRFCLQGLLENSPHLICIGALKKLCNHPCLLFNSIKEKECSSTCDKNEEKSLYKGLLSVFPADYNPLLFTEKESGKLQVLSKLLAVIHELRPTEKVVLVSNYTQTLNILQEVCKRHGYAYTRLDGQTPISQRQQIVDGFNSQHSSFFIFLLSSKAGGVGLNLIGGSHLILYDIDWNPATDIQAMSRVWRDGQKYPVHIYRLLTTGTIEEKIYQRQISKQGLCGAVVDLTKTSEHIQFSVEELKNLFTLHESSDCVTHDLLDCECTGEEVHTGDSLEKFIVSRDCQLGPHHQKSNSLKPLSMSQLKQWKHFSGDHLNLTDPFLERITENVSFIFQNITTQATGT

SEQ ID NO: 71189 - protein, 747 aa, Homo sapiens
  Payload ID: 14100
  Gene Symbol: RAD54L
  Gene Name: RAD54-like (S. cerevisiae)
  Uniprot ID: Q92698
  ENSP ID: ENSP00000361043
MRRSLAPSQLAKRKPEGRSCDDEDWQPGLVTPRKRKSSSETQIQECFLSPFRKPLSQLTNQPPCLDSSQHEAFIRSILSKPFKVPIPNYQGPLGSRALGLKRAGVRRALHDPLEKDALVLYEPPPLSAHDQLKLDKEKLPVHVVVDPILSKVLRPHQREGVKFLWECVTSRRIPGSHGCIMADEMGLGKTLQCITLMWTLLRQSPECKPEIDKAVVVSPSSLVKNWYNEVGKWLGGRIQPLAIDGGSKDEIDQKLEGFMNQRGARVSSPILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 71190 - protein, 747 aa, Homo sapiens; identical to SEQ ID NO: 71189
  Payload ID: 14100
  Gene Symbol: RAD54L
  Gene Name: RAD54-like (S. cerevisiae)
  Uniprot ID: Q92698
  ENSP ID: ENSP00000396113

SEQ ID NO: 71191 - protein, 321 aa, Homo sapiens
  Payload ID: 14100
  Gene Symbol: RAD54L
  Gene Name: RAD54-like (S. cerevisiae)
  ENSP ID: ENSP00000476642
  MOD_RES (1)..(1): Any amino acid
XCLIRRTSDILSKYLPVKIEQVVCCRLTPLQTELYKRFLRQAKPAEELLEGKMSVSSLSSITSLKKLCNRKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 71192 - protein, 202 aa, Homo sapiens
  Payload ID: 14100
  Gene Symbol: RAD54L
  Gene Name: RAD54-like (S. cerevisiae)
  ENSP ID: ENSP00000477172
MRRSLAPSQLAKRKPEGRSCDDEDWQPGLVTPRKRKSSSETQIQECFLSPFRKPLSQLTNQPPCLDSSQHEAFIRSILSKPFKVPIPNYQGPLGSRALGLKRAGVRRALHDPLEKDALVLYEPPPLSAHDQLKLDKEKLPVHVVVDPILSKVLRPHQREGVKFLWECVTSRRIPGSHGCIMADEMGLGKTLQCITLMWTLLR

SEQ ID NO: 71193 - protein, 256 aa, Homo sapiens
  Payload ID: 14100
  Gene Symbol: RAD54L
  Gene Name: RAD54-like (S. cerevisiae)
  ENSP ID: ENSP00000477729
  MOD_RES (1)..(1): Any amino acid
XPLGSRALGLKRAGVRRALHDPLEKDALVLYEPPPLSAHDQLKLDKEKLPVHVVVDPILSKVLRPHQREGVKFLWECVTSRRIPGSHGCIMADEMGLGKTLQCITLMWTLLRQSPECKPEIDKAVVVSPSSLVKNWYNEVGKWLGGRIQPLAIDGGSKDEIDQKLGFMNQRGARVSSPILIISYETFRLHVGVLQKGSVGLVICDEGHRLKNSENQTYQALDSLNTSRRVLISGTPIQNDLLEYFSLVHFVNSGIL

SEQ ID NO: 71194 - protein, 112 aa, Homo sapiens
  Payload ID: 14100
  Gene Symbol: RAD54L
  Gene Name: RAD54-like (S. cerevisiae)
  ENSP ID: ENSP00000479155
  MOD_RES (1)..(1): Any amino acid
XLPVKIEQVVCCRLTPLQTELYKRFLRQAKPAEELLEGKMSVSSLSSITSLKKLCNHPALIYDKCVEEEDGFVGALDLFPPGYSSKALEPQLSGTYTSAWMARCPLRSEPRL

SEQ ID NO: 71195 - protein, 68 aa, Homo sapiens
  Payload ID: 14100
  Gene Symbol: RAD54L
  Gene Name: RAD54-like (S. cerevisiae)
  ENSP ID: ENSP00000479734
VGVLQKGSVGLVICDEGHRLKNSENQTYQALDSLNTSRRVLISGTPIQNDLLEYFSLVHFVNSGILDA

SEQ ID NO: 71196 - protein, 75 aa, Homo sapiens
  Payload ID: 14100
  Gene Symbol: RAD54L
  Gene Name: RAD54-like (S. cerevisiae)
  ENSP ID: ENSP00000479823
MADEMGLGKTLQCITLMWTLLRQSPECKPEIDKAVVVSPSSLVKNWYNEVGKWLGGRIQPLAIDGGSKDEIDQKL

SEQ ID NO: 71197 - protein, 75 aa, Homo sapiens; identical to SEQ ID NO: 71196
  Payload ID: 14100
  Gene Symbol: RAD54L
  Gene Name: RAD54-like (S. cerevisiae)
  ENSP ID: ENSP00000479995

SEQ ID NO: 71198 - protein, 30 aa, Homo sapiens
  Payload ID: 14100
  Gene Symbol: RAD54L
  Gene Name: RAD54-like (S. cerevisiae)
  ENSP ID: ENSP00000480207
MNQRGARVSSPILIISYETFRLHVGVLQKG

SEQ ID NO: 71199 - protein, 60 aa, Homo sapiens
  Payload ID: 14100
  Gene Symbol: RAD54L
  Gene Name: RAD54-like (S. cerevisiae)
  ENSP ID: ENSP00000483843
  MOD_RES (1)..(1): Any amino acid
XLRQSPECKPEIDKAVVVSPSSLVKNWYNEVGKWLGGRIQPLAIDGGSKDEIDQKLGTEP

SEQ ID NO: 71200 - protein, 1467 aa, Homo sapiens
  Payload ID: 14101
  Gene Symbol: RAD54L2
  Gene Name: RAD54-like 2 (S. cerevisiae)
  Uniprot ID: Q9Y4B4
  ENSP ID: ENSP00000386520
MSDESASGSDPDLDPDVELEDAEEEEEEEEVAVEECDRDDEEDLLDDPSLEGMCGTEHAQLGEDGQQPPRCTSTTSSQSEPSEQLRRHQGKNLASEDPKKKRAQKPSHMRRNIRKLLREDQLEPVTKAAQQEELERRKRLEQQRKDYAAPIPTVPLEFLPEEIALRASDGPQLPPRVLAQEVICLDSSSGSEDEKSSRDEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYADVAAARESRQSSPSTNAALPGPPAQLMDSSAVPGTALGTEPRLGGHCLNSSLLVTGQPCGDRHPVLDLRGHKRKLATPPAAQESSRRRSRKGHLPAPVQPYEHGYPVSGGFAMPPVSLNHNLTTPFTSQAGENSLFMGSTPSYYQLSNLLADARLVFPVTTDPLVPAGPVSSSSTATSVTASNPSFMLNPSVPGILPSYSLPFSQPLLSEPRMFAPFPSPVLPSNLSRGMSIYPGYMSPHAGYPAGGLLRSQVPPFDSHEVAEVGFSSNDDEDKDDDVIEVTGK

SEQ ID NO: 71201 - protein, 1296 aa, Homo sapiens
  Payload ID: 14101
  Gene Symbol: RAD54L2
  Gene Name: RAD54-like 2 (S. cerevisiae)
  ENSP ID: ENSP00000410283
  MOD_RES (1)..(1): Any amino acid
XLERRKRLEQQRKDYAAPIPTVPLEFLPEVIELSSGEEDTLHIVDSSESVSEDDEEEEKGGTHVNDVLNQRDALGRVLVNLNHPPEEENVFLAPQLARAVKPHQIGGIRFLYDNLVESLERFKTSSGFGCILAHSMGLGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFRREFEKALCRPGPDVVICDEGHRIKNCQASTSQALKNIRSRRRVVLTGYPLQNNLIEYWCMVDFVRPDFLGTRQEFSNMFERPILNGQCIDSTPQDVRLMRYRSHVLHSLLEGFVQRRGHTVLKIHLPAKEENVILVRLSKIQRDLYTQFMDRFRDCGSSGWLGLNPLKAFCVCCKIWNHPDVLYEALQKESLANEQDLDVEELGSAGTSARCPPQGTKGKGEDSTLASSMGEATNSKFLQGVGFNPFQERGNNIVTYEWAKDLLTNYQTGVLENSPKMVLLFHLIEESVKLGDKILVFSQSLSTLALIEEFLGKREVPCPPGTEGQGAQKWVRNISYFRLDGSTPAFERERLINQFNDPSNLTTWLFLLSTRAGCLGVNLIGANRVVVFDASWNPCHDAQAVCRVYRYGQKKPCYIYRLVADYTLEKKIYDRQISKQGMSDRVVDDLNPMLNFTRKEVENLLHFVEKEPAPQVSLNVKGIKESVLQLACLKYPHLITKEPFEHESLLLNRKDHKLTKAEKKAAKKSYEEDKRTSVPYTRPSYAQYYPASDQSLTSIPAFSQRNWQPTLKGDEKPVASVRPVQSTPIPMMPRHVPLGGSVSSASSTNPSMNFPINYLQRAGVLVQKVVTTTDIVIPGLNSSTDVQARINAGESIHIIRGTKGTYIRTSDGRIFAVRATGKPKVPEDGRMAASGSQGPSCESTSNGRHSASSPKAPDPEGLARPVSPDSPEIISELQQYADVAAARESRQSSPSTNAALPGPPAQLMDSSAVPGTALGTEPRLGGHCLNSSLLVTGQPCGDRHPVLDLRGHKRKLATPPAAQESSRRRSRKGHLPAPVQPYEHGYPVSGGFAMPPVSLNHNLTTPFTSQAGENSLFMGSTPSYYQLSNLLADARLVFPVTTDPLVPAGPVSSSSTATSVTASNPSFMLNPSVPGILPSYSLPFSQPLLSEPRMFAPFPSPVLPSNLSRGMSIYPGYMSPHAGYPAGGLLRSQVPPFDSHEVAEVGFSSNDDEDKDDDVIEVTGK

SEQ ID NO: 71202 - protein, 391 aa, Homo sapiens
  Payload ID: 14102
  Gene Symbol: RAD9A
  Gene Name: RAD9 checkpoint clamp component A
  Uniprot ID: Q99638
  ENSP ID: ENSP00000311360
MKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 71203 - protein, 49 aa, Homo sapiens
  Payload ID: 14102
  Gene Symbol: RAD9A
  Gene Name: RAD9 checkpoint clamp component A
  ENSP ID: ENSP00000442064
MKCLVTGGNVKALPPDGELLPLCLCLLSLCPALLPAIPGSHPWSGPAAL

SEQ ID NO: 71204 - protein, 247 aa, Homo sapiens
  Payload ID: 14102
  Gene Symbol: RAD9A
  Gene Name: RAD9 checkpoint clamp component A
  ENSP ID: ENSP00000444979
MKCLVTGGNVKVLGKAVHSLSRIGDELYLEPLEDGLSLRTVNSSRSAYACFLFAPLFFQQYQAATPGQDLLRCKILMKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFV

SEQ ID NO: 71205 - protein, 118 aa, Homo sapiens
  Payload ID: 14102
  Gene Symbol: RAD9A
  Gene Name: RAD9 checkpoint clamp component A
  ENSP ID: ENSP00000445137
MKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGL

SEQ ID NO: 71206 - protein, 10 aa, Homo sapiens
  Payload ID: 14102
  Gene Symbol: RAD9A
  Gene Name: RAD9 checkpoint clamp component A
  ENSP ID: ENSP00000478994
MKCLVTGGNV

SEQ ID NO: 71207 - protein, 87 aa, Homo sapiens
  Payload ID: 14103
  Gene Symbol: RAD9B
  Gene Name: RAD9 checkpoint clamp component B
  ENSP ID: ENSP00000350777
MSENELDTTLHLKCKLGMKSILPIFRCLNSLERNIEKCRIFTRSDKCKVVIQFFYRHATWMELEVTMLSEISQAWKVKYCMFSQCGR

SEQ ID NO: 71208 - protein, 429 aa, Homo sapiens
  Payload ID: 14103
  Gene Symbol: RAD9B
  Gene Name: RAD9 checkpoint clamp component B
  ENSP ID: ENSP00000376440
MAAMLKCVMSGSQVKVFGKAVQALSRISDEFWLDPSKKGLALRCVNSSRSAYGCVLFSPVFFQHYQWSALVKMSENELDTTLHLKCKLGMKSILPIFRCLNSLERNIEKCRIFTRSDKCKVVIQFFYRHGIKRTHNICFQESQPLQVIFDKNVCTNTLMIQPRLLADAIVLFTSSQEEVTLAVTPLNFCLKSSNEESMDLSNAVHSEMFVGSDEFDFFQIGMDTEITFCFKELKGILTFSEATHAPISIYFDFPGKPLALSIDDMLVEANFILATLADEQSRASSPQSLCLSQKRKRSDLIEKKAGKNVTGQALECISKKAAPRRLYPKETLTNISALENCGSPAMKRVDGDVSEVSESSVSNTEEVPGSLCLRKFSCMFFGAVSSDQQEHFNHPFDSLARASDSEEDMNNVCCRKEFNGSDAKYFCII

SEQ ID NO: 71209 - protein, 417 aa, Homo sapiens
  Payload ID: 14103
  Gene Symbol: RAD9B
  Gene Name: RAD9 checkpoint clamp component B
  ENSP ID: ENSP00000386434
MAAMLKCVMSGSQVKVFGKAVQALSRISDEFWLDPSKKGLALRCVNSSRSAYGCVLFSPVFFQHYQWSALVKMSENELDTTLHLKCKLGMKSILPIFRCLNSLERNIEKCRIFTRSDKCKVVIQFFYRHGIKRTHNICFQESQPLQVIFDKNVCTNTLMIQPRLLADAIVLFTSSQEEVTLAVTPLNFCLKSSNEESMDLSNAVHSEMFVGSDEFDFFQIGMDTEITFCFKELKGILTFSEATHAPISIYFDFPGKPLALSIDDMLVEANFILATLADEQSRASSPQSLCLSQKRKRSDLIEKKAGKNVTGQALECISKKAAPRRLYPKETLTNISALENCGSPAMKRVDGDVSEVSESSVSNTEEVPGSLCLRKFSCMFFGAVSSDQQEHFNHPFDSLARASDSEEDMNNGSFSIF

SEQ ID NO: 71210 - protein, 345 aa, Homo sapiens
  Payload ID: 14103
  Gene Symbol: RAD9B
  Gene Name: RAD9 checkpoint clamp component B
  Uniprot ID: Q6WBX8
  ENSP ID: ENSP00000386629
MSENELDTTLHLKCKLGMKSILPIFRCLNSLERNIEKCRIFTRSDKCKVVIQFFYRHGIKRTHNICFQESQPLQVIFDKNVCTNTLMIQPRLLADAIVLFTSSQEEVTLAVTPLNFCLKSSNEESMDLSNAVHSEMFVGSDEFDFFQIGMDTEITFCFKELKGILTFSEATHAPISIYFDFPGKPLALSIDDMLVEANFILATLADEQSRASSPQSLCLSQKRKRSDLIEKKAGKNVTGQALECISKKAAPRRLYPKETLTNISALENCGSPAMKRVDGDVSEVSESSVSNTEEVPGSLCLRKFSCMFFGAVSSDQQEHFNHPFDSLARASDSEEDMNNGSFSIF

SEQ ID NO: 71211 - protein, 341 aa, Homo sapiens
  Payload ID: 14103
  Gene Symbol: RAD9B
  Gene Name: RAD9 checkpoint clamp component B
  ENSP ID: ENSP00000386697
MAAMLKCVMSGSQVKVFGKAVQALSRISDEFWLDPSKKGLALRCVNSSRSAYGCVLFSPVFFQHYQWSALVKMSENELDTTLHLKCKLGMKSILPIFRCLNSLERNIEKCRIFTRSDKCKVVIQFFYRHDLSNAVHSEMFVGSDEFDFFQIGMDTEITFCFKELKGILTFSEATHAPISIYFDFPGKPLALSIDDMLVEANFILATLADEQSRASSPQSLCLSQKRKRSDLIEKKAGKNVTGQALECISKKAAPRRLYPKETLTNISALENCGSPAMKRVDGDVSEVSESSVSNTEEVPGSLCLRKCAAGKNLMEVMPNISVLSDIEQYPPLPRQPEFGVE

SEQ ID NO: 71212 - protein, 345 aa, Homo sapiens; identical to SEQ ID NO: 71210
  Payload ID: 14103
  Gene Symbol: RAD9B
  Gene Name: RAD9 checkpoint clamp component B
  Uniprot ID: Q6WBX8
  ENSP ID: ENSP00000387329

SEQ ID NO: 71213 - protein, 238 aa, Homo sapiens
  Payload ID: 14104
  Gene Symbol: RHNO1
  Gene Name: RAD9-HUS1-RAD1 interacting nuclear orphan 1
  Uniprot ID: Q9BSD3
  ENSP ID: ENSP00000438590
MPPRKKRRQPSQKAPLLFHQQPLEGPKHSCASTQLPITHTRQVPSKPIDHSTITSWVSPDFDTAAGSLFPAYQKHQNRARHSSRKPTTSKFPHLTFESPQSSSSETLGIPLIRECPSESEKDVSRRPLVPVLSPQSCGNMSVQALQSLPYVFIPPDIQTPESSSVKEELIPQDQKENSLLSCTLHTGTPNSPEPGPVLVKDTPEDKYGIKVTWRRRQHLLAYLRERGKLSRSQFLVKS

SEQ ID NO: 71214 - protein, 224 aa, Homo sapiens
  Payload ID: 14104
  Gene Symbol: RHNO1
  Gene Name: RAD9-HUS1-RAD1 interacting nuclear orphan 1
  Uniprot ID: Q9BSD3
  ENSP ID: ENSP00000438828
MPPRKKRRQPSQKAPLLFHQQPLEGPKHSCASTQLPITHTRQVSPDFDTAAGSLFPAYQKHQNRARHSSRKPTTSKFPHLTFESPQSSSSETLGIPLIRECPSESEKDVSRRPLVPVLSPQSCGNMSVQALQSLPYVFIPPDIQTPESSSVKEELIPQDQKENSLLSCTLHTGTPNSPEPGPVLVKDTPEDKYGIKVTWRRRQHLLAYLRERGKLSRSQFLVKS

SEQ ID NO: 71215 - protein, 131 aa, Homo sapiens
  Payload ID: 14104
  Gene Symbol: RHNO1
  Gene Name: RAD9-HUS1-RAD1 interacting nuclear orphan 1
  ENSP ID: ENSP00000442319
MPPRKKRRQPSQKAPLLFHQQPLEGPKHSCASTQLPITHTRQVPSKPIDHSTITSWVSPDFDTAAGSLFPAYQKHQNRARHSSRKPTTSKFPHLTFESPQSSSSETLGIPLIRECPSESEKDVSRRPLVPV

SEQ ID NO: 71216 - protein, 59 aa, Homo sapiens
  Payload ID: 14104
  Gene Symbol: RHNO1
  Gene Name: RAD9-HUS1-RAD1 interacting nuclear orphan 1
  ENSP ID: ENSP00000442677
MPPRKKRRQPSQKAPLLFHQQPLEGPKHSCASTQLPITHTRQVPSKPIDHSTITSWAFC

SEQ ID NO: 71217 - protein, 64 aa, Homo sapiens
  Payload ID: 14104
  Gene Symbol: RHNO1
  Gene Name: RAD9-HUS1-RAD1 interacting nuclear orphan 1
  ENSP ID: ENSP00000444654
MPPRKKRRQPSQKAPLLFHQQPLEGPKHSCASTQLPITHTRQVPSKPIDHSTITSWVSPDFDTA

SEQ ID NO: 71218 - protein, 105 aa, Homo sapiens
  Payload ID: 14104
  Gene Symbol: RHNO1
  Gene Name: RAD9-HUS1-RAD1 interacting nuclear orphan 1
  ENSP ID: ENSP00000445936
MPPRKKRRQPSQKAPLLFHQQPLEGPKHSCASTQLPITHTRQVPSKPIDHSTITSWVSPDFDTAAGSLFPAYQKHQNRARHSSRKPTTSKFPHLTFESPQSSSSE

SEQ ID NO: 71219 - protein, 238 aa, Homo sapiens; identical to SEQ ID NO: 71213
  Payload ID: 14104
  Gene Symbol: RHNO1
  Gene Name: RAD9-HUS1-RAD1 interacting nuclear orphan 1
  Uniprot ID: Q9BSD3
  ENSP ID: ENSP00000479598

SEQ ID NO: 71220 - protein, 560 aa, Homo sapiens
  Payload ID: 14105
  Gene Symbol: RSPH3
  Gene Name: radial spoke 3 homolog (Chlamydomonas)
  Uniprot ID: Q86UC2
  ENSP ID: ENSP00000252655
MTVKPAKAASLARNLAKRRRTYLGGAAGRSQEPEVPCAAVLPGKPGDRNCPEFPPPDRTLGCWATDAAPAAGLCGAGSEPSIAPTSCAGNLPSRPPPLLSPLLASRNPCPWHYLHLSGSHNTLAPTCFKAKLHRKRGSQPPDMASALTDRTSRAPSTYTYTSRPRALPCQRSRYRDSLTQPDEEPMHYGNIMYDRRVIRGNTYALQTGPLLGRPDSLELQRQREARKRALARKQAQEQLRPQTPEPVEGRKHVDVQTELYLEEIADRIIEVDMECQTDAFLDRPPTPLFIPAKTGKDVATQILEGELFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 71221 - protein, 418 aa, Homo sapiens
  Payload ID: 14105
  Gene Symbol: RSPH3
  Gene Name: radial spoke 3 homolog (Chlamydomonas)
  ENSP ID: ENSP00000356036
MASALTDRTSRAPSTYTYTSRPRALPCQRSRYRDSLTQPDEEPMHYGNIMYDRRVIRGNTYALQTGPLLGRPDSLELQRQREARKRALARKQAQEQLRPQTPEPVEGRKHVDVQTELYLEEIADRIIEVDMECQTDAFLDRPPTPLFIPAKTGKDVATQILEGELFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 71222 - protein, 322 aa, Homo sapiens
  Payload ID: 14105
  Gene Symbol: RSPH3
  Gene Name: radial spoke 3 homolog (Chlamydomonas)
  ENSP ID: ENSP00000393195
MASALTDRTSRAPSTYTYTSRPRALPCQRSRYRDSLTQPDEEPMHYGNIMYDRRVIRGNTYALQTGPLLFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 71223 - protein, 309 aa, Homo sapiens
  Payload ID: 14106
  Gene Symbol: RSPH1
  Gene Name: radial spoke head 1 homolog (Chlamydomonas)
  Uniprot ID: Q8WYR4
  ENSP ID: ENSP00000291536
MSDLGSEELEEEGENDIGEYEGGRNEAGERHGRGRARLPNGDTYEGSYEFGKRHGQGIYKFKNGARYIGEYVRNKKHGQGTFIYPDGSRYEGEWANDLRHGHGVYYYINNDTYTGEWFAHQRHGQGTYLYAETGSKYVGTWVNGQQEGTAELIHLNHRYQGKFLNKNPVGPGKYVFDVGCEQHGEYRLTDMERGEEEEEEELVTVVPKWKATQITELALWTPTLPKKPTSTDGPGQDAPGAESAGEPGEEAQALLEGFEGEMDMRPGDEDADVLREESREYDQEEFRYDMDEGNINSEEEETRQSDLQD

SEQ ID NO: 71224 - protein, 271 aa, Homo sapiens
  Payload ID: 14106
  Gene Symbol: RSPH1
  Gene Name: radial spoke head 1 homolog (Chlamydomonas)
  Uniprot ID: Q8WYR4
  ENSP ID: ENSP00000381395
MSDLGSEELEEEGENDIGGIYKFKNGARYIGEYVRNKKHGQGTFIYPDGSRYEGEWANDLRHGHGVYYYINNDTYTGEWFAHQRHGQGTYLYAETGSKYVGTWVNGQQEGTAELIHLNHRYQGKFLNKNPVGPGKYVFDVGCEQHGEYRLTDMERGEEEEEEELVTVVPKWKATQITELALWTPTLPKKPTSTDGPGQDAPGAESAGEPGEEAQALLEGFEGEMDMRPGDEDADVLREESREYDQEEFRYDMDEGNINSEEEETRQSDLQD

SEQ ID NO: 71225 - protein, 870 aa, Homo sapiens
  Payload ID: 14107
  Gene Symbol: RSPH10B
  Gene Name: radial spoke head 10 homolog B (Chlamydomonas)
  Uniprot ID: P0C881
  ENSP ID: ENSP00000338556
MVKEKKKADKKGEKSARSPSSLSDNLDFSKQDGNTTRQEMSPAGVPLLGMQLNEVKPKKDRQNVQQNEDATQYEESILTKLIVESYEGEKVRGLYEGEGFAAFQGGCTYRGMFSEGLMHGQGTYIWADGLKYEGDFVKNVPMNHGVYTWPDGSMYEGEVVNGMRNGFGMFKCSTQPVSYIGHWCNGKRHGKGSIYYNQEGTCWYEGDWVQNIKKGWGIRCYKSGNIYEGQWEDNMRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQKRSPSLFLCFTKLMTENIRPNAFQIKGNLFREQQRTLYSMSYMNKCWEIYLAYCRPSAAPPHEPTMKMRHFLWMLKDFKMINKELTAATFMEVIAEDNRFIYDGIDSNFEPELVFLEFFEALLSFAFICVTDQMTKSYTNVPADDVSGNKHETIYTILNQDAQNKSPSAVMSHESDAAHSDSARSSSSKLELSPDVNKIRKSEPKIKKSVSHERVSKMNFKLTGKGITFFSSESKKYERPKDDREEEFNTWVNNMYVFFVNTLFHAYKREEAIKEKIRADRLRSTAQAQQRKMEDDELEARLNIFILREEEAKRHDYEVDITVLKEPADVSSSHLILDPPKEDVTVSPSSKTITSKKKKK

SEQ ID NO: 71226 - protein, 870 aa, Homo sapiens; identical to SEQ ID NO: 71225
  Payload ID: 14107
  Gene Symbol: RSPH10B
  Gene Name: radial spoke head 10 homolog B (Chlamydomonas)
  Uniprot ID: P0C881
  ENSP ID: ENSP00000384097

SEQ ID NO: 71227 - protein, 870 aa, Homo sapiens; identical to SEQ ID NO: 71225
  Payload ID: 14107
  Gene Symbol: RSPH10B
  Gene Name: radial spoke head 10 homolog B (Chlamydomonas)
  Uniprot ID: P0C881
  ENSP ID: ENSP00000385443

SEQ ID NO: 71228 - protein, 4 aa, Homo sapiens
  Payload ID: 14107
  Gene Symbol: RSPH10B
  Gene Name: radial spoke head 10 homolog B (Chlamydomonas)
  ENSP ID: ENSP00000390326
MVKE

SEQ ID NO: 71229 - protein, 13 aa, Homo sapiens
  Payload ID: 14107
  Gene Symbol: RSPH10B
  Gene Name: radial spoke head 10 homolog B (Chlamydomonas)
  ENSP ID: ENSP00000444512
MVKEKKKADKKGE

SEQ ID NO: 71230 - protein, 280 aa, Homo sapiens
  Payload ID: 14107
  Gene Symbol: RSPH10B
  Gene Name: radial spoke head 10 homolog B (Chlamydomonas)
  ENSP ID: ENSP00000445203
MRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQQFIP

SEQ ID NO: 71231 - protein, 870 aa, Homo sapiens
  Payload ID: 14108
  Gene Symbol: RSPH10B2
  Gene Name: radial spoke head 10 homolog B2 (Chlamydomonas)
  Uniprot ID: B2RC85
  ENSP ID: ENSP00000297186
MVKEKKKADKKGEKSARSPSSLSDNLDFSKQDGNTTRQEMSPAGVPLLGMQLNEVKPKKDRQNVQQNEDASQYEESILTKLIVESYEGEKVRGLYEGEGFAAFQGGCTYRGMFSEGLMHGQGTYIWADGLKYEGDFVKNVPMNHGVYTWPDGSMYEGEVVNGMRNGFGMFKCSTQPVSYIGHWCNGKRHGKGSIYYNQEGTCWYEGDWVQNIKKGWGIRCYKSGNIYEGQWEDNMRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQKRSPSLFLCFTKLMTENIRPNACQIKGNLFREQQRTLYSMSYMNKCWEIYLAYCRPSAAPPHEPTMKMRHFLWMLKDFKMINKELTAATFMEVIAEDNRFIYDGIDSNFEPELVFLEFFEALLSFAFICVTDQMTKSYTNVPADDVSGNKHETIYTILNQDAQNKSPSAVMSHESDAAHSDSARSSSSKLELSPDVNKIRKSEPKIKKSVSHERVSKMNFKLTGKGITFFSSESKKYERPKDDREEEFNTWVNNTYVFFVNTLFHAYKREEAIKEKIRADRLRSTAQAQQRKMEDDELEARLNIFILREEEAKRHDYEVDITVLKEPADVSSSHLILDPPKEDVTVSPSSKTITSKKKKK

SEQ ID NO: 71232 - protein, 870 aa, Homo sapiens; identical to SEQ ID NO: 71231
  Payload ID: 14108
  Gene Symbol: RSPH10B2
  Gene Name: radial spoke head 10 homolog B2 (Chlamydomonas)
  Uniprot ID: B2RC85
  ENSP ID: ENSP00000384766

SEQ ID NO: 71233 - protein, 870 aa, Homo sapiens; identical to SEQ ID NO: 71231
  Payload ID: 14108
  Gene Symbol: RSPH10B2
  Gene Name: radial spoke head 10 homolog B2 (Chlamydomonas)
  Uniprot ID: B2RC85
  ENSP ID: ENSP00000386102

SEQ ID NO: 71234 - protein, 59 aa, Homo sapiens
  Payload ID: 14108
  Gene Symbol: RSPH10B2
  Gene Name: radial spoke head 10 homolog B2 (Chlamydomonas)
  ENSP ID: ENSP00000395335
MVKEKKKADKKGEKSARSPSSLSDNLDFSKQDGNTTRQEMSPAGVPLLGMQLNEVKPKK

SEQ ID NO: 71235 - protein, 9 aa, Homo sapiens
  Payload ID: 14108
  Gene Symbol: RSPH10B2
  Gene Name: radial spoke head 10 homolog B2 (Chlamydomonas)
  ENSP ID: ENSP00000396498
MVKEKKKAD

SEQ ID NO: 71236 - protein, 323 aa, Homo sapiens
  Payload ID: 14108
  Gene Symbol: RSPH10B2
  Gene Name: radial spoke head 10 homolog B2 (Chlamydomonas)
  ENSP ID: ENSP00000445255
GSIYYNQEGTCWYEGDWVQNIKKGWGIRCYKSGNIYEGQWEDNMRHGEGRMRWLTTNEEYTGRWERGIQNGFGTHTWFLKRIRSSQYPLRNEYIGEFVNGYRHGRGKFYYASGAMYDGEWVSNKKHGMGRLTFKNGRVYEGAFSNDHIAGFPDLEVEFISCLDLSSGVAPRLSRSAELIRKLDGSESHSVLGSSIELDLNLLLDMYPETVQPEEKKQVEYAVLRNITELRRIYSFYSSLGCGHSLDNTFLMTKLHFWRFLKDCKFHHHKLTLADMDRILSANNDIPVEEIHSPFTTILLRTFLNYLLHLAYHIYHEEFQQFIP

SEQ ID NO: 71237 - protein, 348 aa, Homo sapiens
  Payload ID: 14109
  Gene Symbol: RSPH14
  Gene Name: radial spoke head 14 homolog (Chlamydomonas)
  Uniprot ID: Q9UHP6
  ENSP ID: ENSP00000216036
MAHSQNSLELPININATQITTAYGHRALPKLKEELQSEDLQTRQKALMALCDLMHDPECIYKAMNIGCMENLKALLKDSNSMVRIKTTEVLHITASHSVGRYAFLEHDIVLALSFLLNDPSPVCRGNLYKAYMQLVQVPRGAQEIISKGLISSLVWKLQVEVEEEEFQEFILDTLVLCLQEDATEALGSNVVLVLKQKLLSANQNIRSKAARALLNVSISREGKKQVCHFDVIPILVHLLKDPVEHVKSNAAGALMFATVITEGKYAALEAQAIGLLLELLHSPMTIARLNATKALTMLAEAPEGRKALQTHVPTFRAMEVETYEKPQVAEALQRAARIAISVIEFKP

SEQ ID NO: 71238 - protein, 108 aa, Homo sapiens
  Payload ID: 14109
  Gene Symbol: RSPH14
  Gene Name: radial spoke head 14 homolog (Chlamydomonas)
  ENSP ID: ENSP00000385567
MAHSQNSLELPININATQITTAYGHRALPKLKEELQSEDLQTRQKALMALCDLMHDPECIYKAMNIGCMENLKALLKDSNSMVRIKTTEVLHITASHSVGRSSDRKGE

SEQ ID NO: 71239 - protein, 67 aa, Homo sapiens
  Payload ID: 14109
  Gene Symbol: RSPH14
  Gene Name: radial spoke head 14 homolog (Chlamydomonas)
  ENSP ID: ENSP00000391552
QTRQKALMALCDLMHDPECIYKAMNIGCMENLKALLKDSNSMVRIKTTEVLHITASHSVGSSDRKGE

SEQ ID NO: 71240 - protein, 67 aa, Homo sapiens
  Payload ID: 14109
  Gene Symbol: RSPH14
  Gene Name: radial spoke head 14 homolog (Chlamydomonas)
  ENSP ID: ENSP00000406822
  MOD_RES (1)..(1): Any amino acid
XKDSNSMVRIKTTEVLHITASHSVGRYAFLEHDIVLALSFLLNDPSPVCRGNLYKAYMQLVQVPRGT

SEQ ID NO: 71241 - protein, 73 aa, Homo sapiens
  Payload ID: 14109
  Gene Symbol: RSPH14
  Gene Name: radial spoke head 14 homolog (Chlamydomonas)
  ENSP ID: ENSP00000414155
RGNLYKAYMQLVQVPRAENPTINKRTLQRLMYNTCPARLAQDCHSLQNFFGAERQIVQITTFTLSKPDTKKTT

SEQ ID NO: 71242 - protein, 716 aa, Homo sapiens
  Payload ID: 14110
  Gene Symbol: RSPH4A
  Gene Name: radial spoke head 4 homolog A (Chlamydomonas)
  Uniprot ID: Q5TD94
  ENSP ID: ENSP00000229554
MEDSTSPKQEKENQEELGETRRPWEGKTAASPQYSEPESSEPLEAKQGPETGRQSRSSRPWSPQSRAKTPLGGPAGPETSSPAPVSPREPSSSPSPLAPARQDLAAPPQSDRTTSVIPEAGTPYPDPLEQSSDKRESTPHHTSQSEGNTFQQSQQPKPHLCGRRDVSYNNAKQKELRFDVFQEEDSNSDYDLQQPAPGGSEVAPSMLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIAENALPNVMESAFYFEQAGVGLGTDETYRIFLALKQLTDTHPIQRCRFWGKILGLEMNYIVAEVEFREGEDEEEVEEEDVAEERDNGESEAHEDEEDELPKSFYKAPQAIPKEESRTGANKYVYFVCNEPGRPWVKLPPVIPAQIVIARKIKKFFTGRLDAPIISYPPFPGNESNYLRAQIARISAGTHVSPLGFYQFGEEEGEEEEEAEGGRNSFEENPDFEGIQVIDLVESLSNWVHHVQHILSQGRCNWFNSIQKNEEEEEEEDEEKDDSDYIEQEVGLPLLTPISEDLEIQNIPPWTTRLSSNLIPQYAIAVLQSNLWPGAYAFSNGKKFENFYIGWGHKYSPDNYTPPVPPPVYQEYPSGPEITEMDDPSVEEEQAFRAAQEAVLLAAENEESEEDEDEEDDYD

SEQ ID NO: 71243 - protein, 469 aa, Homo sapiens
  Payload ID: 14110
  Gene Symbol: RSPH4A
  Gene Name: radial spoke head 4 homolog A (Chlamydomonas)
  Uniprot ID: Q5TD94
  ENSP ID: ENSP00000357569
MEDSTSPKQEKENQEELGETRRPWEGKTAASPQYSEPESSEPLEAKQGPETGRQSRSSRPWSPQSRAKTPLGGPAGPETSSPAPVSPREPSSSPSPLAPARQDLAAPPQSDRTTSVIPEAGTPYPDPLEQSSDKRESTPHHTSQSEGNTFQQSQQPKPHLCGRRDVSYNNAKQKELRFDVFQEEDSNSDYDLQQPAPGGSEVAPSMLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIGRCNWFNSIQKNEEEEEEEDEEKDDSDYIEQEVGLPLLTPISEDLEIQNIPPWTTRLSSNLIPQYAIAVLQSNLWPGAYAFSNGKKFENFYIGWGHKYSPDNYTPPVPPPVYQEYPSGPEITEMDDPSVEEEQAFRAAQEAVLLAAENEESEEDEDEEDDYD

SEQ ID NO: 71244 - protein, 600 aa, Homo sapiens
  Payload ID: 14110
  Gene Symbol: RSPH4A
  Gene Name: radial spoke head 4 homolog A (Chlamydomonas)
  Uniprot ID: Q5TD94
  ENSP ID: ENSP00000357570
MEDSTSPKQEKENQEELGETRRPWEGKTAASPQYSEPESSEPLEAKQGPETGRQSRSSRPWSPQSRAKTPLGGPAGPETSSPAPVSPREPSSSPSPLAPARQDLAAPPQSDRTTSVIPEAGTPYPDPLEQSSDKRESTPHHTSQSEGNTFQQSQQPKPHLCGRRDVSYNNAKQKELRFDVFQEEDSNSDYDLQQPAPGGSEVAPSMLEITIQNAKAYLLKTSSNSGFNLYDHLSNMLTKILNERPENAVDIFENISQDVKMAHFSKKFDALQNENELLPTYEIAEKQKALFLQGHLEGVDQELEDEIAENALPNVMESAFYFEQAGVGLGTDETYRIFLALKQLTDTHPIQRCRFWGKILGLEMNYIVAEVEFREGEDEEEVEEEDVAEERDNGESEAHEDEEDELPKSFYKAPQAIPKEESRTGANKYVYFVCNEPGRPWVKLPPVIPAQIVIARKIKKFFTGRLDAPIISYPPFPGNESNYLRAQIARISAGTHVSPLGFYQFGEEEGEEEEEAEGGRNSFEENPDFEGIQVIDLVESLSNWVHHVQHILSQRFRIYPPGQHGYPQISFHNMLLQSFNPTFGLEHMPSPMAKSLKIST

SEQ ID NO: 71245 - protein, 717 aa, Homo sapiens
  Payload ID: 14111
  Gene Symbol: RSPH6A
  Gene Name: radial spoke head 6 homolog A (Chlamydomonas)
  Uniprot ID: Q9H0K4
  ENSP ID: ENSP00000221538
MGDLPPYPERPAQQPPGRRTSQASQRRHSRDQAQALAADPEERQQIPPDAQRNAPGWSQRGSLSQQENLLMPQVFQAEEARLGGMEYPSVNTGFPSEFQPQPYSDESRMQVAELTTSLMLQRLQQGQSSLFQQLDPTFQEPPVNPLGQFNLYQTDQFSEGAQHGPYIRDDPALQFLPSELGFPHYSAQVPEPEPLELAVQNAKAYLLQTSINCDLSLYEHLVNLLTKILNQRPEDPLSVLESLNRTTQWEWFHPKLDTLRDDPEMQPTYKMAEKQKALFTRSGGGTEGEQEMEEEVGETPVPNIMETAFYFEQAGVGLSSDESFRIFLAMKQLVEQQPIHTCRFWGKILGIKRSYLVAEVEFREGEEEAEEEEVEEMTEGGEVMEAHGEEEGEEDEEKAVDIVPKSVWKPPPVIPKEESRSGANKYLYFVCNEPGLPWTRLPHVTPAQIVNARKIKKFFTGYLDTPVVSYPPFPGNEANYLRAQIARISAATQVSPLGFYQFSEEEGDEEEEGGAGRDSYEENPDFEGIPVLELVDSMANWVHHTQHILPQGRCTWVNPLQKTEEEEDLGEEEEKADEGPEEVEQEVGPPLLTPLSEDAEIMHLAPWTTRLSCSLCPQYSVAVVRSNLWPGAYAYASGKKFENIYIGWGHKYSPESFNPALPAPIQQEYPSGPEIMEMSDPTVEEEQALKAAQEQALGATEEEEEGEEEEEGEETDD

SEQ ID NO: 71246 - protein, 453 aa, Homo sapiens
  Payload ID: 14111
  Gene Symbol: RSPH6A
  Gene Name: radial spoke head 6 homolog A (Chlamydomonas)
  ENSP ID: ENSP00000471559
MQPTYKMAEKQKALFTRSGGGTEGEQEMEEEVGETPVPNIMETAFYFEQAGVGLSSDESFRIFLAMKQLVEQQPIHTCRFWGKILGIKRSYLVAEVEFREGEEEAEEEEVEEMTEGGEVMEAHGEEEGEEDEEKAVDIVPKSVWKPPPVIPKEESRSGANKYLYFVCNEPGLPWTRLPHVTPAQIVNARKIKKFFTGYLDTPVVSYPPFPGNEANYLRAQIARISAATQVSPLGFYQFSEEEGDEEEEGGAGRDSYEENPDFEGIPVLELVDSMANWVHHTQHILPQGRCTWVNPLQKTEEEEDLGEEEEKADEGPEEVEQEVGPPLLTPLSEDAEIMHLAPWTTRLSCSLCPQYSVAVVRSNLWPGAYAYASGKKFENIYIGWGHKYSPESFNPALPAPIQQEYPSGPEIMEMSDPTVEEEQALKAAQEQALGATEEEEEGEEEEEGEETDD

SEQ ID NO: 71247 - protein, 676 aa, Homo sapiens
  Payload ID: 14111
  Gene Symbol: RSPH6A
  Gene Name: radial spoke head 6 homolog A (Chlamydomonas)
  ENSP ID: ENSP00000472630
MGDLPPYPERPAQQPPGRRTSQASQRRHSRDQAQALAADPEERQQIPPDAQRNAPGWSQRGSLSQQENLLMPQVFQAEEARLGGMEYPSVNTGFPSEFQPQPYSDESRMQVAELTTSLMLQRLQQGQSSLFQQLDPTFQEPPVNPLGQFNLYQTDQFSEGAQHGPYIRDDPALQFLPSELGFPHYSAQVPEPEPLELAVQNAKAYLLQTSINCDLSLYEHLVNLLTKILNQRPEDPLSVLESLNRTTQWEWFHPKLDTLRDDPEMQPTYKMAEKQKALFTRSGGGTEGEQEMEEEVGETPVPNIMETAFYFEQAGVGLSSDESFRIFLAMKQLVEQQPIHTCRFWGKILGIKRSYLVAEVEFREGEEEAEEEEVEEMTEGGEVMEAHGEEEGEEDEEKAVDIVPKSVWKPPPVIPKEESRSGANKYLYFVCNEPGLPWTRLPHVTPAQIVNARKIKKFFTGYLDTPVVSYPPFPGNEANYLRAQIARISAATQVSPLGFYQFSEEEGDEEEEGGAGRDSYEENPDFEGIPVLELVDSMANWVHHTQHILPQGRCTWVNPLQKTEEEEDLGEEEEKADEGPEEVEQEVGPPLLTPLSEDAEIMHLAPWTTRLSCSLCPQYSVAVVRSNLWPGAYAYASGNLRTSTSAGVTSTAPRASTRPCQPPFNKSTPVAQRSWR

SEQ ID NO: 71248 - protein, 276 aa, Homo sapiens
  Payload ID: 14112
  Gene Symbol: RSPH9
  Gene Name: radial spoke head 9 homolog (Chlamydomonas)
  Uniprot ID: Q9H1X1
  ENSP ID: ENSP00000361236
MDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVVQIKEETRLVSVIDQIDKAVAIIPRGALFKTPFGPTHVNRTFEGLSLSEAKKLSSYFHFREPVELKNKTLLEKADLDPSLDFMDSLEHDIPKGSWSIQMERGNALVVLRSLLWPGLTFYHAPRTKNYGYVYVGTGEKNMDLPFML

SEQ ID NO: 71249 - protein, 306 aa, Homo sapiens
  Payload ID: 14112
  Gene Symbol: RSPH9
  Gene Name: radial spoke head 9 homolog (Chlamydomonas)
  Uniprot ID: Q9H1X1
  ENSP ID: ENSP00000361238
MDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVIDKAVAIIPRGALFKTPFGPTHVNRTFEGLSLSEAKKLSSYFHFREPVELKNKTLLEKADLDPSLDFMDSLEHDIPKGSEAVVQGDFTWLLSRCGFGWPCSWDSCSVSMRVLEHPDGEGQCPGGAAQPALAGPHLLPCSPHQELWLRLRGHWREEHGLALHAIEWEPAWMFLNRV

SEQ ID NO: 71250 - protein, 442 aa, Homo sapiens
  Payload ID: 14113
  Gene Symbol: RSAD1
  Gene Name: radical S-adenosyl methionine domain containing 1
  Uniprot ID: Q9HA92
  ENSP ID: ENSP00000258955
MALPGARARGWAAAARAAQRRRRVENAGGSPSPEPAGRRAALYVHWPYCEKRCSYCNFNKYIPRRLEEAAMQKCLVTEAQTLLRLSGVQRVESVFFGGGTPSLASPHTVAAVLEAVAQAAHLPADLEVTLEANPTSAPGSRLAEFGAAGVNRLSIGLQSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEVMLFGHGTRKRVPLGRLELLEEVLALGLRTDVGITHQHWQQFEPQLTLWDVFGANKEVQELLERGLLQLDHRGLRCSWEGLAVLDSLLLTLLPQLQEAWQQRTPSPVPGG

SEQ ID NO: 71251 - protein, 195 aa, Homo sapiens
  Payload ID: 14113
  Gene Symbol: RSAD1
  Gene Name: radical S-adenosyl methionine domain containing 1
  ENSP ID: ENSP00000422893
DDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGALSTHNWTYWQCGQYLGVGPGAHGRFMPQGAGGHTREARIQTLEPDNWMKEAGGSFGPGATHRCGDHSPALAAV

SEQ ID NO: 71252 - protein, 195 aa, Homo sapiens
  Payload ID: 14113
  Gene Symbol: RSAD1
  Gene Name: radical S-adenosyl methionine domain containing 1
  Uniprot ID: Q9HA92
  ENSP ID: ENSP00000424558
MALPGARARGWAAAARAAQRRRRVENAGGSPSPEPAGRRAALYVHSLDDTELRLLGRTHSACDALRTLAEARRLFPGRVSVDLMLGLPAQQVGPWLGQLQELLHHCDDHLSLYQLSLERGTALFAQVQRGALPAPDPELAAEMYQRGRAVLREAGFHQYEVSNFARNGPMDDLCPRGLEATPGRLGSRHWSLTTG

SEQ ID NO: 71253 - protein, 85 aa, Homo sapiens
  Payload ID: 14113
  Gene Symbol: RSAD1
  Gene Name: radical S-adenosyl methionine domain containing 1
  ENSP ID: ENSP00000425372
RARGWAAAARAAQRRRRVENAGGSPSPEPAGRRAALYVHWPYCEKRCSYCNFNKYIPRRLEEAAMQKCLVTEAQTLLRLSGVQRP

SEQ ID NO: 71254 - protein, 32 aa, Homo sapiens
  Payload ID: 14113
  Gene Symbol: RSAD1
  Gene Name: radical S-adenosyl methionine domain containing 1
  ENSP ID: ENSP00000465567
MQKCLVTEAQTLLRLSGVQRVESVFFGGGTPS

SEQ ID NO: 71255 - protein, 361 aa, Homo sapiens
  Payload ID: 14114
  Gene Symbol: RSAD2
  Gene Name: radical S-adenosyl methionine domain containing 2
  Uniprot ID: Q8WXG1
  ENSP ID: ENSP00000371471
MWVLTPAAFAGKLLSVFRQPLSSLWRSLVPLFCWLRATFWLLATKRRKQQLVLRGPDETKEEEEDPPLPTTPTSVNYHFTRQCNYKCGFCFHTAKTSFVLPLEEAKRGLLLLKEAGMEKINFSGGEPFLQDRGEYLGKLVRFCKVELRLPSVSIVSNGSLIRERWFQNYGEYLDILAISCDSFDEEVNVLIGRGQGKKNHVENLQKLRRWCRDYRVAFKINSVINRFNVEEDMTEQIKALNPVRWKVFQCLLIEGENCGEDALREAERFVIGDEEFERFLERHKEVSCLVPESNQKMKDSYLILDEYMRFLNCRKGRKDPSKSILDVGVEEAIKFSGFDEKMFLKRGGKYIWSKADLKLDW

SEQ ID NO: 71256 - protein, 141 aa, Homo sapiens
  Payload ID: 14114
  Gene Symbol: RSAD2
  Gene Name: radical S-adenosyl methionine domain containing 2
  ENSP ID: ENSP00000406427
MCAINGRRSGADAWPRGPRCAAPRACAVPRRRLPGLTPNEAPRRRPQGMEKINFSGGEPFLQDRGEYLGKLVRFCKVELRLPSVSIVSNGSLIRERWFQNYGEYLDILAISCDSFDEEVNVLIGRGQGKKNHVENLQKLRR

SEQ ID NO: 71257 - protein, 583 aa, Homo sapiens
  Payload ID: 14115
  Gene Symbol: RDX
  Gene Name: radixin
  Uniprot ID: P35241
  ENSP ID: ENSP00000342830
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 71258 - protein, 604 aa, Homo sapiens
  Payload ID: 14115
  Gene Symbol: RDX
  Gene Name: radixin
  Uniprot ID: P35241
  ENSP ID: ENSP00000384136
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAMWGPKLYALFQMRSCQSSIKQM

SEQ ID NO: 71259 - protein, 51 aa, Homo sapiens
  Payload ID: 14115
  Gene Symbol: RDX
  Gene Name: radixin
  ENSP ID: ENSP00000431560
MLREDSMMEYLKIAQDLEMYGVNYFEIKNKKGTELWLGVDALGLNIYEHDD

SEQ ID NO: 71260 - protein, 604 aa, Homo sapiens; identical to SEQ ID NO: 71258
  Payload ID: 14115
  Gene Symbol: RDX
  Gene Name: radixin
  Uniprot ID: P35241
  ENSP ID: ENSP00000432112

SEQ ID NO: 71261 - protein, 116 aa, Homo sapiens
  Payload ID: 14115
  Gene Symbol: RDX
  Gene Name: radixin
  ENSP ID: ENSP00000432572
MDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLAS

SEQ ID NO: 71262 - protein, 52 aa, Homo sapiens
  Payload ID: 14115
  Gene Symbol: RDX
  Gene Name: radixin
  ENSP ID: ENSP00000432829
MPKPINVRVTTMDAELEFAIQPNTTGKQLFDQCIGTTQTNKRTVGRKNTELA

SEQ ID NO: 71263 - protein, 257 aa, Homo sapiens
  Payload ID: 14115
  Gene Symbol: RDX
  Gene Name: radixin
  Uniprot ID: P35241
  ENSP ID: ENSP00000433580
MERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAMWGPKLYALFQMRSCQSSIKQM

SEQ ID NO: 71264 - protein, 50 aa, Homo sapiens
  Payload ID: 14115
  Gene Symbol: RDX
  Gene Name: radixin
  ENSP ID: ENSP00000434881
MPKPSCCVPQAGLKLLTSRDPPTLAFQSAGTKDVRHHVQLLLCLLISTCP

SEQ ID NO: 71265 - protein, 44 aa, Homo sapiens
  Payload ID: 14115
  Gene Symbol: RDX
  Gene Name: radixin
  ENSP ID: ENSP00000435930
MPKPAGLKLLTSRDPPTLAFQSAGTKDVRHHVQLLLCLLISTCP

SEQ ID NO: 71266 - protein, 200 aa, Homo sapiens
  Payload ID: 14115
  Gene Symbol: RDX
  Gene Name: radixin
  Uniprot ID: P35241
  ENSP ID: ENSP00000436277
MPKPINVRVTTMDAELEFAIQPNTTGKQLFDQVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQDETKKTQNDVLHAENVKAGRDKYKTLRQIRQGNTKQRIDEFEAMWGPKLYALFQMRSCQSSIKQM

SEQ ID NO: 71267 - protein, 148 aa, Homo sapiens
  Payload ID: 14115
  Gene Symbol: RDX
  Gene Name: radixin
  ENSP ID: ENSP00000437140
MDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLE

SEQ ID NO: 71268 - protein, 604 aa, Homo sapiens; identical to SEQ ID NO: 71258
  Payload ID: 14115
  Gene Symbol: RDX
  Gene Name: radixin
  Uniprot ID: P35241
  ENSP ID: ENSP00000437301

SEQ ID NO: 71269 - protein, 447 aa, Homo sapiens
  Payload ID: 14115
  Gene Symbol: RDX
  Gene Name: radixin
  Uniprot ID: P35241
  ENSP ID: ENSP00000445826
MLSWNLPFSPIQLANNFLTSVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 71270 - protein, 648 aa, Homo sapiens [sequence omitted]

SEQ ID NO: 71271 - protein, 69 aa, Homo sapiens
  Payload ID: 14116
  Gene Symbol: RAF1
  Gene Name: Raf-1 proto-oncogene, serine/threonine kinase
  ENSP ID: ENSP00000391265
MEHIQGAWKTISNGFGFKDAVFDGSSCISPTIVQQFGYQRRASDDGKLTDPSKTSNTIRVFLPNKQRTV

SEQ ID NO: 71272 - protein, 527 aa, Homo sapiens
  Payload ID: 14116
  Gene Symbol: RAF1
  Gene Name: Raf-1 proto-oncogene, serine/threonine kinase
  ENSP ID: ENSP00000398591
RGLQPECCAVFRLLHEHKGKKARLDWNTDAASLIGEELQVDFLDHVPLTTHNFARKTFLKLAFCDICQKFLLNGFRCQTCGYKFHEHCSTKVPTMCVDWSNIRQLFSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 71273 - protein, 69 aa, Homo sapiens; identical to SEQ ID NO: 71271
  Payload ID: 14116
  Gene Symbol: RAF1
  Gene Name: Raf-1 proto-oncogene, serine/threonine kinase
  ENSP ID: ENSP00000401088

SEQ ID NO: 71274 - protein, 668 aa, Homo sapiens
  Payload ID: 14116
  Gene Symbol: RAF1
  Gene Name: Raf-1 proto-oncogene, serine/threonine kinase
  Uniprot ID: P04049
  ENSP ID: ENSP00000401888
MEHIQGAWKTISNGFGFKDAVFDGSSCISPTIVQQFGYQRRASDDGKLTDPSKTSNTIRVFLPNKQRTVVNVRNGMSLHDCLMKALKVRGLQPECCAVFRLLHEHKGKKARLDWNTDAASLIGEELQVDFLDHVPLTTHNFARKTFLKLAFCDICQKFLLNGFRCQTCGYKFHEHCSTKVPTMCVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIENNNLSASPRAWSRRFCLRGRDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 71275 - protein, 501 aa, Homo sapiens
  Payload ID: 14117
  Gene Symbol: RFTN2
  Gene Name: raftlin family member 2
  Uniprot ID: Q52LD8
  ENSP ID: ENSP00000295049
MGCGLRKLEDPDDSSPGKIFSTLKRPQVETKTEFAYEYVLLDFTLQASSNPEVIKINSILDIVTKVENYYLKGYIVGAIHPVIQPVGQRKHLPASYLYRVVLLRLKLSPKNSAAPSGQRRPRLVIEECPLTSEAQTNDAAKELIEKINVAAKRGMKFVGFISQHYSPSKFCNGTNHDGDIESMLHVRHGSDENCRSWNEGTLSGQSSESGIEEELHHESGQYQMEQNGSPTSSKSRKGEASDNKLYTVFNAFDDDSTSWAYQEGILSMKVTRKGSVISTLDADWLELTTFYYKQGLSLIDSFVFWETSKGEHLPKSLEGFFIYEEEGSGVPGSSRKGNDAIVVEQWTVIEGCEIKTDYGPLLHTLAEFGWLLTSVLPTPVLRHDSEGNLATKQIVFLQRPVMWNSAAQTPDKKASRHIKGEDKNKATSRSIGLDTTSSQPAESRHLPEECRLSPSRECWTKEGRLAQHNSFSGFSSSDNVLRELDDGQFDQEDGVTQVTCM

SEQ ID NO: 71276 - protein, 193 aa, Homo sapiens
  Payload ID: 14117
  Gene Symbol: RFTN2
  Gene Name: raftlin family member 2
  ENSP ID: ENSP00000387459
GFFIYEEEGSGVPGSSRKGNDAIVVEQWTVIEGCEIKTDYGPLLHTLAEFGWLLTSVLPTPVLRHDSEGNLATKQIVFLQRPVMWNSAAQTPDMWVRQCEKNKKKASRHIKGEDKNKATSRSIGLDTTSSQPAESRHLPEECRLSPSRECWTKEGRLAQHNSFSGFSSSDNVLRELDDGQFDQEDGVTQVTCM

SEQ ID NO: 71277 - protein, 116 aa, Homo sapiens
  Payload ID: 14117
  Gene Symbol: RFTN2
  Gene Name: raftlin family member 2
  ENSP ID: ENSP00000398128
MGCGLRKLEDPDDSSPGKIFSTLKRPQVETKTEFAYEYVLLDFTLQASSNPEVIKINSILDIVTKVENYYLKGYIVGAIHPVIQPVGQRKHLPASYLYRVVLLRLKLSPKNSAAPS

SEQ ID NO: 71278 - protein, 578 aa, Homo sapiens
  Payload ID: 14118
  Gene Symbol: RFTN1
  Gene Name: raftlin, lipid raft linker 1
  Uniprot ID: Q14699
  ENSP ID: ENSP00000334153
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 71279 - protein, 149 aa, Homo sapiens
  Payload ID: 14118
  Gene Symbol: RFTN1
  Gene Name: raftlin, lipid raft linker 1
  ENSP ID: ENSP00000388718
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQ

SEQ ID NO: 71280 - protein, 114 aa, Homo sapiens
  Payload ID: 14118
  Gene Symbol: RFTN1
  Gene Name: raftlin, lipid raft linker 1
  ENSP ID: ENSP00000393216
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQK

SEQ ID NO: 71281 - protein, 542 aa, Homo sapiens
  Payload ID: 14118
  Gene Symbol: RFTN1
  Gene Name: raftlin, lipid raft linker 1
  ENSP ID: ENSP00000403926
MYCDGAVDLDAAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 71282 - protein, 275 aa, Homo sapiens
  Payload ID: 14118
  Gene Symbol: RFTN1
  Gene Name: raftlin, lipid raft linker 1
  ENSP ID: ENSP00000403997
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSG

SEQ ID NO: 71283 - protein, 149 aa, Homo sapiens; identical to SEQ ID NO: 71279
  Payload ID: 14118
  Gene Symbol: RFTN1
  Gene Name: raftlin, lipid raft linker 1
  ENSP ID: ENSP00000409427

SEQ ID NO: 71284 - protein, 117 aa, Homo sapiens
  Payload ID: 14118
  Gene Symbol: RFTN1
  Gene Name: raftlin, lipid raft linker 1
  ENSP ID: ENSP00000410493
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRKSHLCQ

SEQ ID NO: 71285 - protein, 88 aa, Homo sapiens
  Payload ID: 14118
  Gene Symbol: RFTN1
  Gene Name: raftlin, lipid raft linker 1
  ENSP ID: ENSP00000475367
VQTDYVPLLNSLAAYGWQLTCVLPTPVVKTTSEGSVSTKQIVFLQRPCLPQKIKKKESKFQWRFSREEMHNRQMRKSKVTYGNKSSMS

SEQ ID NO: 71286 - protein, 557 aa, Homo sapiens
  Payload ID: 14119
  Gene Symbol: RALGPS1
  Gene Name: Ral GEF with PH domain and SH3 binding motif 1
  Uniprot ID: Q5JS13
  ENSP ID: ENSP00000259351
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNMMCQLSVVESKSATFPSEKARHLLDDSVLESRSPRRGLALTSSSAVTNGLSLGSSESSEFSEEMSSGLESPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 71287 - protein, 173 aa, Homo sapiens
  Payload ID: 14119
  Gene Symbol: RALGPS1
  Gene Name: Ral GEF with PH domain and SH3 binding motif 1
  ENSP ID: ENSP00000317149
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQKLLELNNLHSLMSVVSALQSAPIFRLTKTWALLNRKDKTTFEKLDYLMSKEDNYKRTREYIRSLKMVPSIPYL

SEQ ID NO: 71288 - protein, 529 aa, Homo sapiens
  Payload ID: 14119
  Gene Symbol: RALGPS1
  Gene Name: Ral GEF with PH domain and SH3 binding motif 1
  Uniprot ID: Q5JS13
  ENSP ID: ENSP00000362533
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNRGRLYATLGPNWRVPVRNSPRTRSCVYSPTGPCICSLGNSAAVPTMEGPLRRKTLLKEGRKPALSSWTRYWVILSGSTLLYYGAKSLRGTDRKHVSIVGWMVQLPDDPEHPDIFQLNNPDKGNVYKFQTGSRFHAILWHKHLDDACKSNRPQEAGAAPGPTGTDSHEVDHLEGGAGKEAGPCA

SEQ ID NO: 71289 - protein, 305 aa, Homo sapiens
  Payload ID: 14119
  Gene Symbol: RALGPS1
  Gene Name: Ral GEF with PH domain and SH3 binding motif 1
  Uniprot ID: Q5JS13
  ENSP ID: ENSP00000362535
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAAM

SEQ ID NO: 71290 - protein, 108 aa, Homo sapiens
  Payload ID: 14119
  Gene Symbol: RALGPS1
  Gene Name: Ral GEF with PH domain and SH3 binding motif 1
  Uniprot ID: Q5JS13
  ENSP ID: ENSP00000377579
MYKRNGLMASVLVTSATPQGSSSSDSLEGQSCDYASKSYDAVVFDVLKVTPEEFASQITLMDIPVFKAIQPEKGWPARMEDSLQKSTVSSRPHDTLQFRKTLPVGPGT

SEQ ID NO: 71291 - protein, 384 aa, Homo sapiens
  Payload ID: 14119
  Gene Symbol: RALGPS1
  Gene Name: Ral GEF with PH domain and SH3 binding motif 1
  Uniprot ID: Q5JS13
  ENSP ID: ENSP00000377590
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAVSHLSSLSHQGQAEEARLKPTSGQHPAWMWPSSSRVPAAPPASAAPRSPWPRNLRNDQGQPGAVALTCNPSTLGSRSRRIT

SEQ ID NO: 71292 - protein, 153 aa, Homo sapiens
  Payload ID: 14119
  Gene Symbol: RALGPS1
  Gene Name: Ral GEF with PH domain and SH3 binding motif 1
  ENSP ID: ENSP00000404021
  MOD_RES (1)..(1): Any amino acid
XNSPRTRSCVYSPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQVPANLMSFE

SEQ ID NO: 71293 - protein, 537 aa, Homo sapiens
  Payload ID: 14119
  Gene Symbol: RALGPS1
  Gene Name: Ral GEF with PH domain and SH3 binding motif 1
  Uniprot ID: Q5JS13
  ENSP ID: ENSP00000415630
MYKRNGLMASVLVTSATPQGSSSSDSLEGQSCDYASKSYDAVVFDVLKVTPEEFASQITLMDIPVFKAIQPEELASCGWSKKEKHSLAPNVVAFTRRFNQVSFWVVREILTAQTLKIRAEILSHFVKIAKKLLELNNLHSLMSVVSALQSAPIFRLTKTWALLNRKDKTTFEKLDYLMSKEDNYKRTREYIRSLKMVPSIPYLGIYLLDLIYIDSAYPASGSIMENEQRSNQMNNILRIIADLQVSCSYDHLTTLPHVQKYLKSVRYIEELQKFVEDDNYKLSLRIEPGSSSPRLVSSKEDLAGPSAGSGSARFSRRPTCPDTSVAGSLPTPPVPRHRKSHSLGNNRGRLYATLGPNWRVPVRNSPRTRSCVYSPTGPCICSLGNSAAVPTMEGPLRRKTLLKEGRKPALSSWTRYWVILSGSTLLYYGAKSLRGTDRKHYKSTPGKKVSIVGWMVQLPDDPEHPDIFQLNNPDKGNVYKFQTGSRFHAILWHKHLDDACKSNRPQEAGAAPGPTGTDSHEVDHLEGGAGKEAGPCA

SEQ ID NO: 71294 - protein, 266 aa, Homo sapiens
  Payload ID: 14120
  Gene Symbol: RALGPS2
  Gene Name: Ral GEF with PH domain and SH3 binding motif 2
  ENSP ID: ENSP00000313613
MDLMNGQASSVNIAATASEGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLV

SEQ ID NO: 71295 - protein, 146 aa, Homo sapiens
  Payload ID: 14120
  Gene Symbol: RALGPS2
  Gene Name: Ral GEF with PH domain and SH3 binding motif 2
  ENSP ID: ENSP00000356604
  MOD_RES (1)..(1): Any amino acid
XQAESSTLSSGISIGSSDGSELSEETSWPAFESSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRM

SEQ ID NO: 71296 - protein, 557 aa, Homo sapiens
  Payload ID: 14120
  Gene Symbol: RALGPS2
  Gene Name: Ral GEF with PH domain and SH3 binding motif 2
  Uniprot ID: Q86X27
  ENSP ID: ENSP00000356606
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFESSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 71297 - protein, 583 aa, Homo sapiens
  Payload ID: 14120
  Gene Symbol: RALGPS2
  Gene Name: Ral GEF with PH domain and SH3 binding motif 2
  Uniprot ID: Q86X27
  ENSP ID: ENSP00000356607
MDLMNGQASSVNIAATASEKSSSSESLSDKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGTSTPRSAASREDLVGPEVGASPQSGRKSVAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFERNRLYHSLGPVTRVARNGYRSHMKASSSAESEDLAVHLYPGAVTIQGVLRRKTLLKEGKKPTVASWTKYWAALCGTQLFYYAAKSLKATERKHFKSTSNKNVSVIGWMVMMADDPEHPDLFLLTDSEKGNSYKFQAGNRMNAMLWFKHLSAACQSNKQQVPTNLMTFE

SEQ ID NO: 71298 - protein, 99 aa, Homo sapiens
  Payload ID: 14120
  Gene Symbol: RALGPS2
  Gene Name: Ral GEF with PH domain and SH3 binding motif 2
  ENSP ID: ENSP00000405903
  MOD_RES (1)..(1): Any amino acid
XQYIEELQKFVEDDNYKLSLKIEPGTSTPRSAASREDLVGPEVGASPQSGRKSVAAEGALLPQTPPSPRNLIPHGHRKCHSLGYKSAFLILSFKFLSLL

SEQ ID NO: 71299 - protein, 2083 aa, Homo sapiens
  Payload ID: 14121
  Gene Symbol: RALGAPA1
  Gene Name: Ral GTPase activating protein, alpha subunit 1 (catalytic)
  Uniprot ID: Q6GYQ0
  ENSP ID: ENSP00000302647
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDAGSYPEILPSETPTATQVDGADLASPMSPRTSKSRMSMKLRRSSGSANKS

SEQ ID NO: 71300 - protein, 2049 aa, Homo sapiens
  Payload ID: 14121
  Gene Symbol: RALGAPA1
  Gene Name: Ral GTPase activating protein, alpha subunit 1 (catalytic)
  Uniprot ID: Q6GYQ0
  ENSP ID: ENSP00000371803
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKEAEQNATRGSTEGSVQSCNGLFWKESCSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDADH

SEQ ID NO: 71301 - protein, 2036 aa, Homo sapiens
  Payload ID: 14121
  Gene Symbol: RALGAPA1
  Gene Name: Ral GTPase activating protein, alpha subunit 1 (catalytic)
  Uniprot ID: Q6GYQ0
  ENSP ID: ENSP00000374348
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDADH

SEQ ID NO: 71302 - protein, 356 aa, Homo sapiens
  Payload ID: 14121
  Gene Symbol: RALGAPA1
  Gene Name: Ral GTPase activating protein, alpha subunit 1 (catalytic)
  ENSP ID: ENSP00000450574
  MOD_RES (1)..(1): Any amino acid
XNDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDAVERNAVIVLFLPKPPLENIGHLKAPTQRFYPVKLPQQRR

SEQ ID NO: 71303 - protein, 722 aa, Homo sapiens
  Payload ID: 14121
  Gene Symbol: RALGAPA1
  Gene Name: Ral GTPase activating protein, alpha subunit 1 (catalytic)
  ENSP ID: ENSP00000451133
QILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDAVGSYPEILPSETPTATQVDGADLASPMSPRTSKSRMSMKLRRSSGSANKS

SEQ ID NO: 71304 - protein, 2083 aa, Homo sapiens
  Payload ID: 14121
  Gene Symbol: RALGAPA1
  Gene Name: Ral GTPase activating protein, alpha subunit 1 (catalytic)
  Uniprot ID: Q6GYQ0
  ENSP ID: ENSP00000451877
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVAMRSRSIGECALPSAYIRSAKSAPVLIHTSKPFLPDIVLTPLSDELSDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDADH

SEQ ID NO: 71305 - protein, 1873 aa, Homo sapiens
  Payload ID: 14122
  Gene Symbol: RALGAPA2
  Gene Name: Ral GTPase activating protein, alpha subunit 2 (catalytic)
  Uniprot ID: Q2PPJ7
  ENSP ID: ENSP00000202677
MFSRRSHGDVKKSTQKVLDPKKDVLTRLKHLRALLDNVDANDLKQFFETNYSQIYFIFYENFIALENSLKLKGNNKSQREELDSILFLFEKILQFLPERIFFRWHYQSIGSTLKKLLHTGNSIKIRCEGIRLFLLWLQALQTNCAEEQVLIFACLVPGFPAVMSSRGPCTLETLINPSPSVADVKIYPEEITPLLPAISGEKIAEDQTCFFLQILLKYMVIQAASLEWKNKENQDTGFKFLFTLFRKYYLPHLFPSFTKLTNIYKPVLDIPHLRPKPVYITTTRDNENIYSTKIPYMAARVVFIKWIVTFFLEKKYLTATQNTKNGVDVLPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKQIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIIQNHREVMTFEDFAAQVFSPSPSYSLSGTD

SEQ ID NO: 71306 - protein, 250 aa, Homo sapiens
  Payload ID: 14122
  Gene Symbol: RALGAPA2
  Gene Name: Ral GTPase activating protein, alpha subunit 2 (catalytic)
  ENSP ID: ENSP00000388695
  MOD_RES (1)..(1): Any amino acid
XQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSLYLFALNV

SEQ ID NO: 71307 - protein, 1740 aa, Homo sapiens
  Payload ID: 14122
  Gene Symbol: RALGAPA2
  Gene Name: Ral GTPase activating protein, alpha subunit 2 (catalytic)
  ENSP ID: ENSP00000400085
  MOD_RES (1)..(1): Any amino acid
XKIYPEEITPLLPAISGEKIAEDQTCFFLQILLKYMVIQAASLEWKNKENQDTGFKFLFTLFRKYYLPHLFPSFTKLTNIYKPVLDIPHLRPKPVYITTTRDNENIYSTKIPYMAARVVFIKWIVTFFLEKKYLTATQNTKNGVDVLPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKQIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIIQNHREVMTFEDFAAQVFSPSPSYSLSGTGALASSLSADLEEPLSEEETEHPLLPLPRATKPRISRKFRCCTSALSRSSH

SEQ ID NO: 71308 - protein, 237 aa, Homo sapiens
  Payload ID: 14122
  Gene Symbol: RALGAPA2
  Gene Name: Ral GTPase activating protein, alpha subunit 2 (catalytic)
  ENSP ID: ENSP00000481660
MNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIFRTTAK

SEQ ID NO: 71309 - protein, 1494 aa, Homo sapiens
  Payload ID: 14123
  Gene Symbol: RALGAPB
  Gene Name: Ral GTPase activating protein, beta subunit (non-catalytic)
  Uniprot ID: Q86X10
  ENSP ID: ENSP00000262879
MYSEWRSLHLVIQNDQGHTSVLHSYPESVGREVANAVVRPLGQVLGTPSVAGSENLLKTDKEVKWTMEVICYGLTLPLDGETVKYCVDVYTDWIMALVLPKDSIPLPVIKEPNQYVQTILKHLQNLFVPRQEQGSSQIRLCLQVLRAIQKLARESSLMARETWEVLLLFLLQINDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYALNTDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 71310 - protein, 1494 aa, Homo sapiens; identical to SEQ ID NO: 71309
  Payload ID: 14123
  Gene Symbol: RALGAPB
  Gene Name: Ral GTPase activating protein, beta subunit (non-catalytic)
  Uniprot ID: Q86X10
  ENSP ID: ENSP00000380233

SEQ ID NO: 71311 - protein, 1491 aa, Homo sapiens
  Payload ID: 14123
  Gene Symbol: RALGAPB
  Gene Name: Ral GTPase activating protein, beta subunit (non-catalytic)
  Uniprot ID: Q86X10
  ENSP ID: ENSP00000380235
MYSEWRSLHLVIQNDQGHTSVLHSYPESVGREVANAVVRPLGQVLGTPSVAGSENLLKTDKEVKWTMEVICYGLTLPLDGETVKYCVDVYTDWIMALVLPKDSIPLPVIKEPNQYVQTILKHLQNLFVPRQEQGSSQIRLCLQVLRAIQKLARESSLMARETWEVLLLFLLQINDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 71312 - protein, 1323 aa, Homo sapiens
  Payload ID: 14123
  Gene Symbol: RALGAPB
  Gene Name: Ral GTPase activating protein, beta subunit (non-catalytic)
  ENSP ID: ENSP00000416646
INDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYALNTDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 71313 - protein, 866 aa, Homo sapiens
  Payload ID: 14123
  Gene Symbol: RALGAPB
  Gene Name: Ral GTPase activating protein, beta subunit (non-catalytic)
  ENSP ID: ENSP00000487816
  MOD_RES (1)..(1): Any amino acid
XEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYGSTALNTDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 71314 - protein, 902 aa, Homo sapiens
  Payload ID: 14124
  Gene Symbol: RALGDS
  Gene Name: ral guanine nucleotide dissociation stimulator
  Uniprot ID: Q12967
  ENSP ID: ENSP00000361117
MVQRMWAEAAGPAGGAEPLFPGSRRSRSVWDAVRLEVGVPDSCPVVLHSFTQLDPDLPRPESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 71315 - protein, 914 aa, Homo sapiens
  Payload ID: 14124
  Gene Symbol: RALGDS
  Gene Name: ral guanine nucleotide dissociation stimulator
  Uniprot ID: Q12967
  ENSP ID: ENSP00000361120
MVQRMWAEAAGPAGGAEPLFPGSRRSRSVWDAVRLEVGVPDSCPVVLHSFTQLDPDLPRPESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 71316 - protein, 885 aa, Homo sapiens
  Payload ID: 14124
  Gene Symbol: RALGDS
  Gene Name: ral guanine nucleotide dissociation stimulator
  Uniprot ID: Q12967
  ENSP ID: ENSP00000361132
MCLWGHSTAPAHTLSSPPLLFCSLPCALHLQPGTGHPPGQVPRKSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 71317 - protein, 913 aa, Homo sapiens
  Payload ID: 14124
  Gene Symbol: RALGDS
  Gene Name: ral guanine nucleotide dissociation stimulator
  Uniprot ID: Q12967
  ENSP ID: ENSP00000376864
MAREAGQVCARPAVPRGRKGSVFFACVSVVTARRRAVARRAALQSPTPWLAPLPAPATTESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 71318 - protein, 859 aa, Homo sapiens
  Payload ID: 14124
  Gene Symbol: RALGDS
  Gene Name: ral guanine nucleotide dissociation stimulator
  Uniprot ID: Q12967
  ENSP ID: ENSP00000376867
MMVDCQSSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGRCDALTASSRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVTSQDKAPAVIRKAMDKHNLEEEEPEDYELLQILSDDRKLKIPENANVFYAMNSTANYDFVLKKRTFTKGVKVKHGASSTLPRMKQKGLKIAKGIF

SEQ ID NO: 71319 - protein, 308 aa, Homo sapiens
  Payload ID: 14124
  Gene Symbol: RALGDS
  Gene Name: ral guanine nucleotide dissociation stimulator
  ENSP ID: ENSP00000391814
VVAENGLSEEKPHLLVFPPDLVAEQFTLMDAECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPE

SEQ ID NO: 71320 - protein, 824 aa, Homo sapiens
  Payload ID: 14124
  Gene Symbol: RALGDS
  Gene Name: ral guanine nucleotide dissociation stimulator
  ENSP ID: ENSP00000488067
MVQRMWAEAAGPAGGAEPLFPGSRRSRSVWDAVRLEVGVPDSCPVVLHSFTQLDPDLPRPESSTQEIGEELINGVIYSISLRKVQLHHGGNKGQRWLGYENESALNLYETCKVRTVKAGTLEKLVEHLVPAFQGSDLSYVTIFLCTYRAFTTTQQVLDLLFKRYGCILPYSDEDGGPQDQLKNAISSILGTWLDQYSEDFCQPPDFPCLKQLVAYVQLNMPGSDLERRAHLLLAQLEHSEPIEAEPEALSPVPALKPTPELELALTPARAPSPVPAPAPEPEPAPTPAPGSELEVAPAPAPELQQAPEPAVGLESAPAPALELEPAPEQDPAPSQTLELEPAPAPVPSLQPSWPSPVVAENGLSEEKPHLLVFPPDLVAEQFTLMDAELFKKVVPYHCLGSIWSQRDKKGKEHLAPTIRATVTQFNSVANCVITTCLGNRSTKAPDRARVVEHWIEVARECRILKNFSSLYAILSALQSNSIHRLKKTWEDVSRDSFRIFQKLSEIFSDENNYSLSRELLIKEGTSKFATLEMNPKRAQKRPKETGIIQGTVPYLGTFLTDLVMLDTAMKDYLYGRLINFEKRRKEFEVIAQIKLLQSACNNYSIAPDEQFGAWFRAVERLSETESYNLSCELEPPSESASNTLRTKKNTAIVKRWSDRQAPSTELSTSGSSHSKSCDQLRCGPYLSSGDIADALSVHSAGSSSSDVEEINISFVPESPDGQEKKFWESASQSSPETSGISSASSSTSSSSASTTPVAATRTHKRSVSGLCNSSSALPLYNQQVGDCCIIRVSLDVDNGNMYKSILVSRRGWPGCLPPLAANAP

SEQ ID NO: 71321 - protein, 803 aa, Homo sapiens
  Payload ID: 14125
  Gene Symbol: RGL1
  Gene Name: ral guanine nucleotide dissociation stimulator-like 1
  Uniprot ID: Q9NZL6
  ENSP ID: ENSP00000303192
MEVKPVGEPTQEVSKFKLSTKVESTGHWLVEDHVRIWEVLKTEESSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 71322 - protein, 768 aa, Homo sapiens
  Payload ID: 14125
  Gene Symbol: RGL1
  Gene Name: ral guanine nucleotide dissociation stimulator-like 1
  Uniprot ID: Q9NZL6
  ENSP ID: ENSP00000354097
MKLLWQAKMSSIQDWGEEVEEGAVYHVTLKRVQIQQAANKGARWLGVEGDQLPPGHTVSQYETCKIRTIKAGTLEKLVENLLTAFGDNDFTYISIFLSTYRGFASTKEVLELLLDRYGNLTSPNCEEDGSQSSSESKMVIRNAIASILRAWLDQCAEDFREPPHFPCLQKLLDYLTRMMPGSDPERRAQNLLEQFQKQEVETDNGLPNTISFSLEEEEELEGGESAEFTCFSEDLVAEQLTYMDAQLFKKVVPHHCLGCIWSRRDKKENKHLAPTIRATISQFNTLTKCVVSTILGGKELKTQQRAKIIEKWINIAHECRLLKNFSSLRAIVSALQSNSIYRLKKTWAAVPRDRMLMFEELSDIFSDHNNHLTSRELLMKEGTSKFANLDSSVKENQKRTQRRLQLQKDMGVMQGTVPYLGTFLTDLTMLDTALQDYIEGGLINFEKRRREFEVIAQIKLLQSACNSYCMTPDQKFIQWFQRQQLLTEEESYALSCEIEAAADASTTSPKPRKSMVKRLSLLFLGSDMITSPTPTKEQPKSTASGSSGESMDSVSVSSCESNHSEAEEGSITPMDTPDEPQKKLSESSSSCSSIHSMDTNSSGMSSLINPLSSPPSCNNNPKIHKRSVSVTSITSTVLPPVYNQQNEDTCIIRISVEDNNGNMYKSIMLTSQDKTPAVIQRAMLKHNLDSDPAEEYELVQVISEDKELVIPDSANVFYAMNSQVNFDFILRKKNSMEEQVKLRSRTSLTLPRTAKRGCWSNRHSKITL

SEQ ID NO: 71323 - protein, 777 aa, Homo sapiens
  Payload ID: 14126
  Gene Symbol: RGL2
  Gene Name: ral guanine nucleotide dissociation stimulator-like 2
  Uniprot ID: O15211
  ENSP ID: ENSP00000372691
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 71324 - protein, 146 aa, Homo sapiens
  Payload ID: 14126
  Gene Symbol: RGL2
  Gene Name: ral guanine nucleotide dissociation stimulator-like 2
  ENSP ID: ENSP00000387453
MLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALES

SEQ ID NO: 71325 - protein, 777 aa, Homo sapiens; identical to SEQ ID NO: 71323
  Payload ID: 14126
  Gene Symbol: RGL2
  Gene Name: ral guanine nucleotide dissociation stimulator-like 2
  Uniprot ID: O15211
  ENSP ID: ENSP00000390098

SEQ ID NO: 71326 - protein, 146 aa, Homo sapiens; identical to SEQ ID NO: 71324
  Payload ID: 14126
  Gene Symbol: RGL2
  Gene Name: ral guanine nucleotide dissociation stimulator-like 2
  ENSP ID: ENSP00000392918

SEQ ID NO: 71327 - protein, 146 aa, Homo sapiens; identical to SEQ ID NO: 71324
  Payload ID: 14126
  Gene Symbol: RGL2
  Gene Name: ral guanine nucleotide dissociation stimulator-like 2
  ENSP ID: ENSP00000397558

SEQ ID NO: 71328 - protein, 146 aa, Homo sapiens; identical to SEQ ID NO: 71324
  Payload ID: 14126
  Gene Symbol: RGL2
  Gene Name: ral guanine nucleotide dissociation stimulator-like 2
  ENSP ID: ENSP00000398125

SEQ ID NO: 71329 - protein, 777 aa, Homo sapiens; identical to SEQ ID NO: 71323
  Payload ID: 14126
  Gene Symbol: RGL2
  Gene Name: ral guanine nucleotide dissociation stimulator-like 2
  Uniprot ID: O15211
  ENSP ID: ENSP00000407088

SEQ ID NO: 71330 - protein, 777 aa, Homo sapiens; identical to SEQ ID NO: 71323
  Payload ID: 14126
  Gene Symbol: RGL2
  Gene Name: ral guanine nucleotide dissociation stimulator-like 2
  Uniprot ID: O15211
  ENSP ID: ENSP00000412152

SEQ ID NO: 71331 - protein, 146 aa, Homo sapiens; identical to SEQ ID NO: 71324
  Payload ID: 14126
  Gene Symbol: RGL2
  Gene Name: ral guanine nucleotide dissociation stimulator-like 2
  ENSP ID: ENSP00000412625

SEQ ID NO: 71332 - protein, 777 aa, Homo sapiens; identical to SEQ ID NO: 71323
  Payload ID: 14126
  Gene Symbol: RGL2
  Gene Name: ral guanine nucleotide dissociation stimulator-like 2
  Uniprot ID: O15211
  ENSP ID: ENSP00000420211

SEQ ID NO: 71333 - protein, 710 aa, Homo sapiens
  Payload ID: 14127
  Gene Symbol: RGL3
  Gene Name: ral guanine nucleotide dissociation stimulator-like 3
  ENSP ID: ENSP00000369823
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDHPAHSDLGSVRTFLGWAAPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 71334 - protein, 716 aa, Homo sapiens
  Payload ID: 14127
  Gene Symbol: RGL3
  Gene Name: ral guanine nucleotide dissociation stimulator-like 3
  Uniprot ID: Q3MIN7
  ENSP ID: ENSP00000377075
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDHPAHSDLGSVRTFLGWAAPGSAEAQKAEKLLEDFLEEAEREQEEEPPQVWTGPPRVAQTSDPDSSEACAEEEEGLMPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSLCISPSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRVLLIPDNANVFYAMSPVAPRDFMLRRKEGTRNTLSVSPS

SEQ ID NO: 71335 - protein, 250 aa, Homo sapiens
  Payload ID: 14127
  Gene Symbol: RGL3
  Gene Name: ral guanine nucleotide dissociation stimulator-like 3
  ENSP ID: ENSP00000454678
  MOD_RES (1)..(1): Any amino acid
XRTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDHPAHSDLGSVRTFLGWAAPGSAEAQKAEKLLEDFLEEAEREQEEEPPQDLPELPKLLTQTLQRPARRKRKGSCLKVPSSWTSAWTRWPSS

SEQ ID NO: 71336 - protein, 181 aa, Homo sapiens
  Payload ID: 14127
  Gene Symbol: RGL3
  Gene Name: ral guanine nucleotide dissociation stimulator-like 3
  ENSP ID: ENSP00000455922
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGDQEDSGTRSELQQEPEGCGVSAGLLAAGPPSGFPRPPCPFGPGQCPNLSGLGGPREC

SEQ ID NO: 71337 - protein, 167 aa, Homo sapiens
  Payload ID: 14127
  Gene Symbol: RGL3
  Gene Name: ral guanine nucleotide dissociation stimulator-like 3
  ENSP ID: ENSP00000456429
MERTAGKELALAPLQDWGEETEDGAVYSVSLRRQRSQRRSPAEGPGGSQAPSPIANTFLHYRTSKVRVLRAARLERLVGELVFGDREQDPSFMPAFLATYRTFVPTACLLGFLLPPMPPPPPPGVEIKKTAVQDLSFNKNLRTTLRISETTLPIRTWAVSEPFWAGR

SEQ ID NO: 71338 - protein, 176 aa, Homo sapiens
  Payload ID: 14127
  Gene Symbol: RGL3
  Gene Name: ral guanine nucleotide dissociation stimulator-like 3
  ENSP ID: ENSP00000464876
MRRPGRKGTGGGQAPSPIANTFLHYRTSKVRVLRAARLERLVGELVFGDREQDPSFMPAFLATYRTFVPTACLLGFLLPPMPPPPPPGVEIKKTAVQDLSFNKNLRAVVSVLGSWLQDHPQDFRDHPAHSDLGSVRTFLGWAAPGSAEAQKAEKLLEDFLEEAEREQEEEPPQVWT

SEQ ID NO: 71339 - protein, 77 aa, Homo sapiens
  Payload ID: 14127
  Gene Symbol: RGL3
  Gene Name: ral guanine nucleotide dissociation stimulator-like 3
  ENSP ID: ENSP00000466669
  MOD_RES (1)..(1): Any amino acid
XLGSVWSQRDRPGAAGASPTVRATVAQFNTVTGCVLGSVLGAPGLAAPQRAQRLEKWIRIAQGTAIYFQETFADFLR

SEQ ID NO: 71340 - protein, 473 aa, Homo sapiens
  Payload ID: 14128
  Gene Symbol: RGL4
  Gene Name: ral guanine nucleotide dissociation stimulator-like 4
  Uniprot ID: Q8IZJ4
  ENSP ID: ENSP00000290691
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 71341 - protein, 337 aa, Homo sapiens
  Payload ID: 14128
  Gene Symbol: RGL4
  Gene Name: ral guanine nucleotide dissociation stimulator-like 4
  ENSP ID: ENSP00000383951
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 71342 - protein, 155 aa, Homo sapiens
  Payload ID: 14128
  Gene Symbol: RGL4
  Gene Name: ral guanine nucleotide dissociation stimulator-like 4
  ENSP ID: ENSP00000393115
  MOD_RES (1)..(1): Any amino acid
XWASGMSTVPGGSRHSLGIQVRGGWGVTGGEEESLTVPVADTWQAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKESYKLSCQLEPENP

SEQ ID NO: 71343 - protein, 435 aa, Homo sapiens
  Payload ID: 14128
  Gene Symbol: RGL4
  Gene Name: ral guanine nucleotide dissociation stimulator-like 4
  ENSP ID: ENSP00000396252
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKRDDGENNGNSYRKLSPQRPCEVAVVCITLYRRGNSLREARLQDWVTHTGSVDLGQWRGALRWPPRRGTPRESR

SEQ ID NO: 71344 - protein, 536 aa, Homo sapiens
  Payload ID: 14128
  Gene Symbol: RGL4
  Gene Name: ral guanine nucleotide dissociation stimulator-like 4
  ENSP ID: ENSP00000402142
MRKLLTNLPAAAVLSAQVYSAVLQGLWEENVCGTPGRTRVCTALLYGQVCPFQDSTDGLRTITSILFNWPPENTSVYYQPPQRSSFRIKLAFRNLSWPGLGLEDHQEIVLGQLVLPEPNEAKPDDPAPRPGQHALTMPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKERWGFTMMSRIVSNSWPQAIHPPQPPKVLTLQLQAVLPAGARKPVGWQHPAVAGNPPGCWPEHRLCTIPHPDRRHQG

SEQ ID NO: 71345 - protein, 410 aa, Homo sapiens
  Payload ID: 14128
  Gene Symbol: RGL4
  Gene Name: ral guanine nucleotide dissociation stimulator-like 4
  ENSP ID: ENSP00000480308
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKERLHCSVTISVHCNVCLLGSSPSSASQAAGTTAVHHHVRLFCCCCSATSCPASWSPKTRRLATSCSGWEPTGMLARTPALHHPSPRP

SEQ ID NO: 71346 - protein, 356 aa, Homo sapiens
  Payload ID: 14128
  Gene Symbol: RGL4
  Gene Name: ral guanine nucleotide dissociation stimulator-like 4
  ENSP ID: ENSP00000484573
MPALEPAPPLLADLGPALEPESPAALGPPGYLHSAPGPAPAPGEGPPPGTVLEPQSAPESSCPCRGSVKNQPSEELPDMTTFPPRLLAEQLTLMDAELFKKVVLHECLGCIWGQGHLKGNEHMAPTVRATIAHFNRLTNCITTSCLGDHSMRARDRARVVEHWIKVARECLSLNNFSSVHVIVSALCSNPIGQLHKTWAGVSSKSMKELKELCKKDTAVKRDLLIKAGSFKVATQERNPQRVQMRLRRQKKGVVPFLGDFLTELQRLDSAIPDDLDGNTNKRSKEVRVLQEMQLLQVAAMNYRLRPLEKFVTYFTRMEQLSDKERWGFTMMSRIVSNSWPQAIHPPQPPKVLTLQV

SEQ ID NO: 71347 - protein, 655 aa, Homo sapiens
  Payload ID: 14129
  Gene Symbol: RALBP1
  Gene Name: ralA binding protein 1
  Uniprot ID: Q15311
  ENSP ID: ENSP00000019317
MTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHKEEKHKEKKSKDLTAADVVKQWKEKKKKKKPIQEPEVPQIDVPNLKPIFGIPLADAVERTMMYDGIRLPAVFRECIDYVEKYGMKCEGIYRVSGIKSKVDELKAAYDREESTNLEDYEPNTVASLLKQYLRDLPENLLTKELMPRFEEACGRTTETEKVQEFQRLLKELPECNYLLISWLIVHMDHVIAKELETKMNIQNISIVLSPTVQISNRVLYVFFTHVQELFGNVVLKQVMKPLRWSNMATMPTLPETQAGIKEEIRRQEFLLNCLHRDLQGGIKDLSKEERLWEVQRILTALKRKLREAKRQECETKIAQEIASLSKEDVSKEEMNENEEVINILLAQENEILTEQEELLAMEQFLRRQIASEKEEIERLRAEIAEIQSRQQHGRSETEEYSSESESESEDEEELQIILEDLQRQNEELEIKNNHLNQAIHEEREAIIELRVQLRLLQMQRAKAEQQAQEDEEPEWRGGAVQPPRDGVLEPKAAKEQPKAGKEPAKPSPSRDRKETSI

SEQ ID NO: 71348 - protein, 655 aa, Homo sapiens; identical to SEQ ID NO: 71347
  Payload ID: 14129
  Gene Symbol: RALBP1
  Gene Name: ralA binding protein 1
  Uniprot ID: Q15311
  ENSP ID: ENSP00000372924

SEQ ID NO: 71349 - protein, 207 aa, Homo sapiens
  Payload ID: 14129
  Gene Symbol: RALBP1
  Gene Name: ralA binding protein 1
  ENSP ID: ENSP00000411556
MTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHKEEKHKEKKSKDLTAADVVKQWKEKKKKKKPIQEPEVPQIDVPNLKPIFGIPLADAVERTMMYDGI

SEQ ID NO: 71350 - protein, 3 aa, Homo sapiens
  Payload ID: 14129
  Gene Symbol: RALBP1
  Gene Name: ralA binding protein 1
  ENSP ID: ENSP00000462549
MTE

SEQ ID NO: 71351 - protein, 186 aa, Homo sapiens
  Payload ID: 14129
  Gene Symbol: RALBP1
  Gene Name: ralA binding protein 1
  ENSP ID: ENSP00000463693
MTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHKEEKHKEKKSKDLTAADVVKQWKEKKKKKKPIQEPEVPQIDVPNL

SEQ ID NO: 71352 - protein, 795 aa, Homo sapiens
  Payload ID: 14130
  Gene Symbol: REPS1
  Gene Name: RALBP1 associated Eps domain containing 1
  Uniprot ID: Q96D71
  ENSP ID: ENSP00000258062
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVDGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 71353 - protein, 769 aa, Homo sapiens
  Payload ID: 14130
  Gene Symbol: REPS1
  Gene Name: RALBP1 associated Eps domain containing 1
  Uniprot ID: Q96D71
  ENSP ID: ENSP00000356635
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 71354 - protein, 705 aa, Homo sapiens
  Payload ID: 14130
  Gene Symbol: REPS1
  Gene Name: RALBP1 associated Eps domain containing 1
  Uniprot ID: Q96D71
  ENSP ID: ENSP00000386699
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEDTAIVHPVPIRMTPSKIHMQEMELKRTGSDHTNPTSPLLVKPSDLLEENKINSSVKFASGNTVGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 71355 - protein, 796 aa, Homo sapiens
  Payload ID: 14130
  Gene Symbol: REPS1
  Gene Name: RALBP1 associated Eps domain containing 1
  Uniprot ID: Q96D71
  ENSP ID: ENSP00000392065
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEQWETFSERSSSSQTLTQFDSNIAPADPDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 71356 - protein, 737 aa, Homo sapiens
  Payload ID: 14130
  Gene Symbol: REPS1
  Gene Name: RALBP1 associated Eps domain containing 1
  ENSP ID: ENSP00000397941
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEDTAIVHPVPIRMTPSKIHMQEMELKRTGSDHTNPTSPLLVKPSDLLEENKINSSVKFASGNTVADGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 71357 - protein, 220 aa, Homo sapiens
  Payload ID: 14130
  Gene Symbol: REPS1
  Gene Name: RALBP1 associated Eps domain containing 1
  ENSP ID: ENSP00000401729
MEGLTLSDAEQKYYSDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGNSQTLIKMVH

SEQ ID NO: 71358 - protein, 147 aa, Homo sapiens
  Payload ID: 14130
  Gene Symbol: REPS1
  Gene Name: RALBP1 associated Eps domain containing 1
  ENSP ID: ENSP00000402609
TPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSAALML

SEQ ID NO: 71359 - protein, 102 aa, Homo sapiens
  Payload ID: 14130
  Gene Symbol: REPS1
  Gene Name: RALBP1 associated Eps domain containing 1
  ENSP ID: ENSP00000403740
  MOD_RES (1)..(1): Any amino acid
XTDEQRQYYVNQFKTIQPDLNGFIPGSAAKEFFTKSKLPILELSHIWELSDFDKDGALTLDEFCAAFHLVVARKNGYDLPEKLPESLMPKLIDLEDSAALML

SEQ ID NO: 71360 - protein, 121 aa, Homo sapiens
  Payload ID: 14130
  Gene Symbol: REPS1
  Gene Name: RALBP1 associated Eps domain containing 1
  ENSP ID: ENSP00000431474
  MOD_RES (1)..(1): Any amino acid
XPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGNSQTLIKMVH

SEQ ID NO: 71361 - protein, 152 aa, Homo sapiens
  Payload ID: 14130
  Gene Symbol: REPS1
  Gene Name: RALBP1 associated Eps domain containing 1
  ENSP ID: ENSP00000432157
  MOD_RES (1)..(1): Any amino acid
XEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRMFLRREFPWKFNWNNFDHSLTYKPIAVNCEHTCF

SEQ ID NO: 71362 - protein, 754 aa, Homo sapiens
  Payload ID: 14130
  Gene Symbol: REPS1
  Gene Name: RALBP1 associated Eps domain containing 1
  ENSP ID: ENSP00000434251
SDLFSYCDIESTKKVVVNGRVLELFRAAQLPNDVVLQIMELCGATRLGYFGRSQFYIALKLVAVAQSGFPLRVESINTVKDLPLPRFVASKNEQESRHAASYSSDSENQGSYSGVIPPPPGRGQVKKGSVSHDTVQPRTSADAQEPASPVVSPQQSPPTSPHTWRKHSRHPSGGNSERPLAGPGPFWSPFGEAQSGSSAGDAVWSGHSPPPPQENWVSFADTPPTSTLLTMHPASVQDQTTVRTVASATTAIEIRRQSSSYDDPWKITDEQRQYYVNQFKTIQPDLNGFIPGSAAKEFFTKSKLPILELSHIWELSDFDKDGALTLDEFCAAFHLVVARKNGYDLPEKLPESLMPKLIDLEDSADVGDQPGEVGYSGSPAEAPPSKSPSMPSLNQTWPELNQSSEDTAIVHPVPIRMTPSKIHMQEMELKRTGSDHTNPTSPLLVKPSDLLEENKINSSVKFASGNTVDGYSSSDSFTSDPEQIGSNVTRQRSHSGTSPDNTAPPPPPPRPQPSHSRSSSLDMNRTFTVTTGQQQAGVVAHPPAVPPRPQPSQAPGPAVHRPVDADGLITHTSTSPQQIPEQPNFADFSQFEVFAASNVNDEQDDEAEKHPEVLPAEKASDPASSLRVAKTDSKTEEKTAASAPANVSKGTTPLAPPPKPVRRRLKSEDELRPEVDEHTQKTGVLAAVLASQPSIPRSVGKDKKAIQASIRRNKETNTVLARLNSELQQQLKDVLEERISLEVQLEQLRPFSHL

SEQ ID NO: 71363 - protein, 146 aa, Homo sapiens
  Payload ID: 14130
  Gene Symbol: REPS1
  Gene Name: RALBP1 associated Eps domain containing 1
  ENSP ID: ENSP00000435131
ELNQSSEWETFSERSSSSQTLTQFDSNIAPADPDTAIVHPVPIRMTPSKIHMQEMELKRTGSDHTNPTSPLLVKPSDLLEENKINSSVKFASGNTVGQQQAGVVAHPPAVPPRPQPSQAPGPAVHRPVDADGLITHTSTSPQQIPE

SEQ ID NO: 71364 - protein, 61 aa, Homo sapiens
  Payload ID: 14130
  Gene Symbol: REPS1
  Gene Name: RALBP1 associated Eps domain containing 1
  ENSP ID: ENSP00000435236
  MOD_RES (1)..(1): Any amino acid
XVDEHTQKTGVLAAVLASQPSIPRSVGKDKKAIQASIRRNKETNTVLARLNSELQQQLKVI

SEQ ID NO: 71365 - protein, 220 aa, Homo sapiens; identical to SEQ ID NO: 71357
  Payload ID: 14130
  Gene Symbol: REPS1
  Gene Name: RALBP1 associated Eps domain containing 1
  ENSP ID: ENSP00000435392

SEQ ID NO: 71366 - protein, 220 aa, Homo sapiens; identical to SEQ ID NO: 71357
  Payload ID: 14130
  Gene Symbol: REPS1
  Gene Name: RALBP1 associated Eps domain containing 1
  ENSP ID: ENSP00000487438

SEQ ID NO: 71367 - protein, 659 aa, Homo sapiens
  Payload ID: 14131
  Gene Symbol: REPS2
  Gene Name: RALBP1 associated Eps domain containing 2
  Uniprot ID: Q8NFH8
  ENSP ID: ENSP00000306033
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 71368 - protein, 660 aa, Homo sapiens
  Payload ID: 14131
  Gene Symbol: REPS2
  Gene Name: RALBP1 associated Eps domain containing 2
  Uniprot ID: Q8NFH8
  ENSP ID: ENSP00000349824
MEAAAAAAAAAAAAAAAGGGCGSGPPPLLLSEGEQQCYSELFARCAGAAGGGPGSGPPEAARVAPGTATAAAGPVADLFRASQLPAETLHQITELCGAKRVGYFGPTQFYIALKLIAAAQSGLPVRIESIKCELPLPRFMMSKNDGEIRFGNPAELHGTKVQIPYLTTEKNSFKRMDDEDKQQETQSPTMSPLASPPSSPPHYQRVPLSHGYSKLRSSAEQMHPAPYEARQPLVQPEGSSSGGPGTKPLRHQASLIRSFSVERELQDNSSYPDEPWRITEEQREYYVNQFRSLQPDPSSFISGSVAKNFFTKSKLSIPELSYIWELSDADCDGALTLPEFCAAFHLIVARKNGYPLPEGLPPTLQPEYLQAAFPKPKWDCQLFDSYSESLPANQQPRDLNRMEKTSVKDMADLPVPNQDVTSDDKQALKSTINEALPKDVSEDPATPKDSNSLKARPRSRSYSSTSIEEAMKRGEDPPTPPPRPQKTHSRASSLDLNKVFQPSVPATKSGLLPPPPALPPRPCPSQSEQVSEAELLPQLSRAPSQAAESSPAKKDVLYSQPPSKPIRRKFRPENQATENQEPSTAASGPASAATMKPHPTVQKQSSKQKKAIQTAIRKNKEANAVLARLNSELQQQLKEVHQERIALENQLEQLRPVTVL

SEQ ID NO: 71369 - protein, 306 aa, Homo sapiens
  Payload ID: 14132
  Gene Symbol: RALY
  Gene Name: RALY heterogeneous nuclear ribonucleoprotein
  Uniprot ID: Q9UKM9
  ENSP ID: ENSP00000246194
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSSRPPAPQENTTSEAGLPQGEARTRDDGDEEGLLTHSEEELEHSQDTDADDGALQ

SEQ ID NO: 71370 - protein, 171 aa, Homo sapiens
  Payload ID: 14132
  Gene Symbol: RALY
  Gene Name: RALY heterogeneous nuclear ribonucleoprotein
  ENSP ID: ENSP00000327522
MSLKLQASNVTNKNDPKSINSRVFIGNLNTALVKKSDVETIFSNGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGG

SEQ ID NO: 71371 - protein, 290 aa, Homo sapiens
  Payload ID: 14132
  Gene Symbol: RALY
  Gene Name: RALY heterogeneous nuclear ribonucleoprotein
  Uniprot ID: Q9UKM9
  ENSP ID: ENSP00000364255
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSSRPPAPQENTTSEAGLPQGEARTRDDGDEEGLLTHSEEELEHSQDTDADDGALQ

SEQ ID NO: 71372 - protein, 89 aa, Homo sapiens
  Payload ID: 14132
  Gene Symbol: RALY
  Gene Name: RALY heterogeneous nuclear ribonucleoprotein
  ENSP ID: ENSP00000403744
MSLKLQASNVTNKNDPKSINSRVFIGNLNTALVKKSDVETIFSKYGRVAGCSVHKGYAFVQYSNERHARAAVLGENGRVLAGQTLDINM

SEQ ID NO: 71373 - protein, 181 aa, Homo sapiens
  Payload ID: 14132
  Gene Symbol: RALY
  Gene Name: RALY heterogeneous nuclear ribonucleoprotein
  ENSP ID: ENSP00000413638
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIK

SEQ ID NO: 71374 - protein, 237 aa, Homo sapiens
  Payload ID: 14132
  Gene Symbol: RALY
  Gene Name: RALY heterogeneous nuclear ribonucleoprotein
  ENSP ID: ENSP00000415973
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSS

SEQ ID NO: 71375 - protein, 85 aa, Homo sapiens
  Payload ID: 14133
  Gene Symbol: RALYL
  Gene Name: RALY RNA binding protein-like
  ENSP ID: ENSP00000427787
MTGKTQTSNVTNKNDPKSINSRVFIGNLNTAIVKKVDIEAIFSKYGKIVGCSVHKGYAFVQYMSERHARAAVAGENARVIAGQPL

SEQ ID NO: 71376 - protein, 146 aa, Homo sapiens
  Payload ID: 14133
  Gene Symbol: RALYL
  Gene Name: RALY RNA binding protein-like
  ENSP ID: ENSP00000428310
MTMYKSKRRHQRYINMAGEPKPYRPKPGNKRPLSALYRLESKEPFLSVGLFDYHGRVPPPPRAVIPLKRPRVAVTTTRRGKGVFSMKGGSRSTASGSTGSKLKSDELQTIKKELTQIKTKIDSLLGRLEKIEKQQKAEAVSTDKVI

SEQ ID NO: 71377 - protein, 291 aa, Homo sapiens
  Payload ID: 14133
  Gene Symbol: RALYL
  Gene Name: RALY RNA binding protein-like
  Uniprot ID: Q86SE5
  ENSP ID: ENSP00000428667
MTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 71378 - protein, 85 aa, Homo sapiens; identical to SEQ ID NO: 71375
  Payload ID: 14133
  Gene Symbol: RALYL
  Gene Name: RALY RNA binding protein-like
  ENSP ID: ENSP00000428711

SEQ ID NO: 71379 - protein, 218 aa, Homo sapiens
  Payload ID: 14133
  Gene Symbol: RALYL
  Gene Name: RALY RNA binding protein-like
  Uniprot ID: Q86SE5
  ENSP ID: ENSP00000428807
MTMYKSKRRHQRYINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 71380 - protein, 47 aa, Homo sapiens
  Payload ID: 14133
  Gene Symbol: RALYL
  Gene Name: RALY RNA binding protein-like
  ENSP ID: ENSP00000429284
MTGKTQTSNVTNKNDPKSINSRVFIGNLNTAIVKKVDIEAIFSKYGK

SEQ ID NO: 71381 - protein, 280 aa, Homo sapiens
  Payload ID: 14133
  Gene Symbol: RALYL
  Gene Name: RALY RNA binding protein-like
  ENSP ID: ENSP00000430065
MTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYSGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 71382 - protein, 304 aa, Homo sapiens
  Payload ID: 14133
  Gene Symbol: RALYL
  Gene Name: RALY RNA binding protein-like
  Uniprot ID: Q86SE5
  ENSP ID: ENSP00000430128
MSKRRRLKQGEPIMTGKTQTSNVTNKNDPKSINSRVFIGNLNTAIVKKVDIEAIFSKYGKIVGCSVHKGYAFVQYMSERHARAAVAGENARVIAGQPLDINMAGEPKPYRPKPGNKRPLSALYRLESKEPFLSVGGYVFDYDYYRDDFYNRLFDYHGRVPPPPRAVIPLKRPRVAVTTTRRGKGVFSMKGGSRSTASGSTGSKLKSDELQTIKKELTQIKTKIDSLLGRLEKIEKQQKAEAEAQKKQLEESLVLIQEECVSEIADHSTEEPAEGGPDADGEEMTDGIEEDFDEDGGHELFLQIK

SEQ ID NO: 71383 - protein, 291 aa, Homo sapiens; identical to SEQ ID NO: 71377
  Payload ID: 14133
  Gene Symbol: RALYL
  Gene Name: RALY RNA binding protein-like
  Uniprot ID: Q86SE5
  ENSP ID: ENSP00000430367

SEQ ID NO: 71384 - protein, 291 aa, Homo sapiens; identical to SEQ ID NO: 71377
  Payload ID: 14133
  Gene Symbol: RALYL
  Gene Name: RALY RNA binding protein-like
  Uniprot ID: Q86SE5
  ENSP ID: ENSP00000430394

SEQ ID NO: 71385 - protein, 201 aa, Homo sapiens
  Payload ID: 14134
  Gene Symbol: RANBP1
  Gene Name: RAN binding protein 1
  Uniprot ID: P43487
  ENSP ID: ENSP00000327583
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 71386 - protein, 200 aa, Homo sapiens
  Payload ID: 14134
  Gene Symbol: RANBP1
  Gene Name: RAN binding protein 1
  Uniprot ID: P43487
  ENSP ID: ENSP00000384925
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKGSGKNDHAEKVAEKLEALSVKEETKEDAEEKQ

SEQ ID NO: 71387 - protein, 73 aa, Homo sapiens
  Payload ID: 14134
  Gene Symbol: RANBP1
  Gene Name: RAN binding protein 1
  ENSP ID: ENSP00000390139
MGSALGRARRTLSGRPFQRAPCKTRRALSLSAALRNVTKAQGGCPKSLVLWGCRPKRPRKRRTSLKLAWRGHS

SEQ ID NO: 71388 - protein, 163 aa, Homo sapiens
  Payload ID: 14134
  Gene Symbol: RANBP1
  Gene Name: RAN binding protein 1
  ENSP ID: ENSP00000395472
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAESEPRALGTCLTWGSPAW

SEQ ID NO: 71389 - protein, 53 aa, Homo sapiens
  Payload ID: 14134
  Gene Symbol: RANBP1
  Gene Name: RAN binding protein 1
  ENSP ID: ENSP00000400940
MRAKLFRFASENDLPEWKERGTGDVKLLKHKEKGAIRLLMRRDKTLKICANHY

SEQ ID NO: 71390 - protein, 278 aa, Homo sapiens
  Payload ID: 14134
  Gene Symbol: RANBP1
  Gene Name: RAN binding protein 1
  ENSP ID: ENSP00000401564
MGSALGRARRTLSGRPFQRAPCKTRRALSLSAALRNVTKAQGGCPKSLVLWGCRPKRPRKRRTSLKLAWRGTFCSSSLKISEDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 71391 - protein, 53 aa, Homo sapiens; identical to SEQ ID NO: 71389
  Payload ID: 14134
  Gene Symbol: RANBP1
  Gene Name: RAN binding protein 1
  ENSP ID: ENSP00000404126

SEQ ID NO: 71392 - protein, 204 aa, Homo sapiens
  Payload ID: 14134
  Gene Symbol: RANBP1
  Gene Name: RAN binding protein 1
  ENSP ID: ENSP00000404298
MRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKGDVVPWVGGLLCRLTLHLTILPGGCFFCLPDKHSRVLWPPHVSRVMQLPGDTGASWGALSTCQCCWPQSNWAGIGVRALPGAHQKV

SEQ ID NO: 71393 - protein, 165 aa, Homo sapiens
  Payload ID: 14134
  Gene Symbol: RANBP1
  Gene Name: RAN binding protein 1
  ENSP ID: ENSP00000404724
MGSALGRARRTLSGRPFQRAPCKTRRALSLSAALRNVTKAQGGCPKSLVLWGCRPKRPRKRRTSLKLAWRGTFCSSSLKISEDTHEDHDTSTENTDESNHDPQFEPIVSLPEQEIKTLEEDEEELFKMRAKLFRFASENDLPEWKERGTGDVKLLKHKEKGAIRL

SEQ ID NO: 71394 - protein, 145 aa, Homo sapiens
  Payload ID: 14134
  Gene Symbol: RANBP1
  Gene Name: RAN binding protein 1
  ENSP ID: ENSP00000413502
MRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKGSGKNDHAEKVAEKLEALSVKEETKED

SEQ ID NO: 71395 - protein, 620 aa, Homo sapiens
  Payload ID: 14135
  Gene Symbol: RANBP10
  Gene Name: RAN binding protein 10
  Uniprot ID: Q6VN20
  ENSP ID: ENSP00000316589
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGYMGIGLSAQGVNMNRLPGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 71396 - protein, 594 aa, Homo sapiens
  Payload ID: 14135
  Gene Symbol: RANBP10
  Gene Name: RAN binding protein 10
  Uniprot ID: Q6VN20
  ENSP ID: ENSP00000392808
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGYMGIGLSAQGVNMNRLPGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSNPWLQLERRPNQAAPTTPPGPTPTSTPPHSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 71397 - protein, 82 aa, Homo sapiens
  Payload ID: 14135
  Gene Symbol: RANBP10
  Gene Name: RAN binding protein 10
  ENSP ID: ENSP00000473395
MAAATADPGAGNPQPGDSSGGGAGGGLPSPGEQELSRRLQRLYPAVNQQETPLPRSWSPKDKYNYIGLSQGNLRVHYKVTWE

SEQ ID NO: 71398 - protein, 650 aa, Homo sapiens
  Payload ID: 14135
  Gene Symbol: RANBP10
  Gene Name: RAN binding protein 10
  ENSP ID: ENSP00000473396
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGYMGIGLSAQGVNMNRLPGWDKHSYGYHGDDGHSFCSSGTGQPYGPTFTTGDVIGCCVNLINGTCFYTKNGHSLGIAFTDLPANLYPTVGLQTPGEIVDANFGQQPFLFDIEDYMREWRAKVQGTVHCFPISARLGEWQAVLQNMVSSYLVHHGYCATATAFARMTETPIQEEQASIKNRQKIQKLVLEGRVGEAIETTQRFYPGLLEHNPNLLFMLKCRQFVEMVNGTDSEVRSLSSRSPKSQDSYPGSPSLSPRHGPSSSHMHNTGADSPSCSNGVASTKSKQNHSKYPAPSSSSSSSSSSSSSSPSSVNYSESNSTDSTKSQHHSSTSNQETSNPWLQLERRPNQAAPTTPPGPTPTSTPPHSDSEMEMEAEHYPNGVLGSMSTRIVNGAYKHEDLQTDESSMDDRHPRRQLCGGNQAATERIILFGRELQALSEQLGREYGKNLAHTEMLQDAFSLLAYSDPWSCPVGQQLDPIQREPVCAALNSAILESQNLPKQPPLMLALGQASECLRLMARAGLGSCSFARVDDYLH

SEQ ID NO: 71399 - protein, 149 aa, Homo sapiens
  Payload ID: 14135
  Gene Symbol: RANBP10
  Gene Name: RAN binding protein 10
  ENSP ID: ENSP00000473538
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGYMGIGLSAQGVNMNRLPDPTSRNLSSLLQVQQR

SEQ ID NO: 71400 - protein, 126 aa, Homo sapiens
  Payload ID: 14135
  Gene Symbol: RANBP10
  Gene Name: RAN binding protein 10
  ENSP ID: ENSP00000473554
MAAATADPGAGNPQPGDSSGGGAGGGLPSPGEQELSRRLQRLYPAVNQQETPLPRSWSPKDKYNYIGLSQGNLRVHYKGHGKNHKDAASVRATHPIPAACGIYYFEVKIVSKGRDGLGQTFLWLPW

SEQ ID NO: 71401 - protein, 620 aa, Homo sapiens [sequence omitted]

SEQ ID NO: 71402 - protein, 576 aa, Homo sapiens
  Payload ID: 14136
  Gene Symbol: RANBP17
  Gene Name: RAN binding protein 17
  Uniprot ID: Q9H2T7
  ENSP ID: ENSP00000373770
MALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKKTDIFL

SEQ ID NO: 71403 - protein, 1088 aa, Homo sapiens
  Payload ID: 14136
  Gene Symbol: RANBP17
  Gene Name: RAN binding protein 17
  Uniprot ID: Q9H2T7
  ENSP ID: ENSP00000427975
MALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKVYARMSEVLGITDDNHVLETFMTKIVTNLKYWGRYEPVISRTLQFLNDLSVGYILLKKLVKIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 71404 - protein, 47 aa, Homo sapiens
  Payload ID: 14136
  Gene Symbol: RANBP17
  Gene Name: RAN binding protein 17
  ENSP ID: ENSP00000427980
  MOD_RES (1)..(1): Any amino acid
XSLMDTGLPRCCNEKIELAILWFLDQFRKTYVGDQLQRTSKKTDIFL

SEQ ID NO: 71405 - protein, 576 aa, Homo sapiens; identical to SEQ ID NO: 71402
  Payload ID: 14136
  Gene Symbol: RANBP17
  Gene Name: RAN binding protein 17
  Uniprot ID: Q9H2T7
  ENSP ID: ENSP00000429298

SEQ ID NO: 71406 - protein, 38 aa, Homo sapiens
  Payload ID: 14136
  Gene Symbol: RANBP17
  Gene Name: RAN binding protein 17
  ENSP ID: ENSP00000429609
MDIRNYILNYVASQPKLAPFVIQALIQVIAKITKLGWF

SEQ ID NO: 71407 - protein, 554 aa, Homo sapiens
  Payload ID: 14136
  Gene Symbol: RANBP17
  Gene Name: RAN binding protein 17
  ENSP ID: ENSP00000429845
  MOD_RES (1)..(1): Any amino acid
XALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKKTDIFL

SEQ ID NO: 71408 - protein, 576 aa, Homo sapiens; identical to SEQ ID NO: 71402
  Payload ID: 14136
  Gene Symbol: RANBP17
  Gene Name: RAN binding protein 17
  Uniprot ID: Q9H2T7
  ENSP ID: ENSP00000430444

SEQ ID NO: 71409 - protein, 175 aa, Homo sapiens
  Payload ID: 14136
  Gene Symbol: RANBP17
  Gene Name: RAN binding protein 17
  ENSP ID: ENSP00000430577
  MOD_RES (1)..(1): Any amino acid
XLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQHWEFAPNSVHYLLTLWQRMVASVPFVKSTEPHLLDTYAPEITKAFITSRLDSVAIVVRDHLDDPLDDTATVFQQ

SEQ ID NO: 71410 - protein, 576 aa, Homo sapiens; identical to SEQ ID NO: 71402
  Payload ID: 14136
  Gene Symbol: RANBP17
  Gene Name: RAN binding protein 17
  Uniprot ID: Q9H2T7
  ENSP ID: ENSP00000430599

SEQ ID NO: 71411 - protein, 580 aa, Homo sapiens
  Payload ID: 14136
  Gene Symbol: RANBP17
  Gene Name: RAN binding protein 17
  ENSP ID: ENSP00000430958
MALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKEVAGDCILLN

SEQ ID NO: 71412 - protein, 518 aa, Homo sapiens
  Payload ID: 14136
  Gene Symbol: RANBP17
  Gene Name: RAN binding protein 17
  ENSP ID: ENSP00000478243
VYARMSEVLGITDDNHVLETFMTKIVTNLKYWGRYEPVISRTLQFLNDLSVGYPFHSRCVQIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 71413 - protein, 3224 aa, Homo sapiens
  Payload ID: 14137
  Gene Symbol: RANBP2
  Gene Name: RAN binding protein 2
  Uniprot ID: P49792
  ENSP ID: ENSP00000283195
MRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKHSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 71414 - protein, 51 aa, Homo sapiens
  Payload ID: 14137
  Gene Symbol: RANBP2
  Gene Name: RAN binding protein 2
  ENSP ID: ENSP00000398970
MRRSKADVERYIASVQGSTPSPRQKSMKGFYFAKLYYEAKEYDLAKNVQWN

SEQ ID NO: 71415 - protein, 51 aa, Homo sapiens; identical to SEQ ID NO: 71414
  Payload ID: 14137
  Gene Symbol: RANBP2
  Gene Name: RAN binding protein 2
  ENSP ID: ENSP00000485979

SEQ ID NO: 71416 - protein, 499 aa, Homo sapiens
  Payload ID: 14138
  Gene Symbol: RANBP3
  Gene Name: RAN binding protein 3
  Uniprot ID: Q9H6Z4
  ENSP ID: ENSP00000034275
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 71417 - protein, 567 aa, Homo sapiens
  Payload ID: 14138
  Gene Symbol: RANBP3
  Gene Name: RAN binding protein 3
  Uniprot ID: Q9H6Z4
  ENSP ID: ENSP00000341483
MADLANEEKPAIAPPVFVFQKDKGQKSPAEQKNLSDSGEEPRGEAEAPHHGTGHPESAGEHALEPPAPAGASASTPPPPAPEAQLPPFPRELAGRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 71418 - protein, 562 aa, Homo sapiens
  Payload ID: 14138
  Gene Symbol: RANBP3
  Gene Name: RAN binding protein 3
  Uniprot ID: Q9H6Z4
  ENSP ID: ENSP00000404837
MADLANEEKPAIAPPVFVFQKDKGQKSPAEQKNLSDSGEEPRGEAEAPHHGTGHPESAGEHALEPPAPAGASASTPPPPAPEAQLPPFPRELAGRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 71419 - protein, 73 aa, Homo sapiens
  Payload ID: 14138
  Gene Symbol: RANBP3
  Gene Name: RAN binding protein 3
  ENSP ID: ENSP00000464705
MADLANEEKPAIAPPVFVFQKDKGQKRSAGGSSPEGGEDSDREDGNYCPPVKRERTSSLTQFPPSQSGAFQAC

SEQ ID NO: 71420 - protein, 155 aa, Homo sapiens
  Payload ID: 14138
  Gene Symbol: RANBP3
  Gene Name: RAN binding protein 3
  ENSP ID: ENSP00000464774
MQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDE

SEQ ID NO: 71421 - protein, 81 aa, Homo sapiens
  Payload ID: 14138
  Gene Symbol: RANBP3
  Gene Name: RAN binding protein 3
  ENSP ID: ENSP00000464986
MLHCRLTSGFEGRVLSLAKVKKTGKRKSLPLLRPSLCFRRIKDKSPLQSKKTCRIRERSLGGRLRPPTMARVTPSQLASMP

SEQ ID NO: 71422 - protein, 494 aa, Homo sapiens
  Payload ID: 14138
  Gene Symbol: RANBP3
  Gene Name: RAN binding protein 3
  ENSP ID: ENSP00000465085
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 71423 - protein, 51 aa, Homo sapiens
  Payload ID: 14138
  Gene Symbol: RANBP3
  Gene Name: RAN binding protein 3
  ENSP ID: ENSP00000466510
MENAGHPSADTPTATNYFLQYISSSLENSTNSADASSNKFVFGQNMSERVL

SEQ ID NO: 71424 - protein, 139 aa, Homo sapiens
  Payload ID: 14138
  Gene Symbol: RANBP3
  Gene Name: RAN binding protein 3
  ENSP ID: ENSP00000466638
MKPSRVWETPFVDAFAVHIMAETKISLREKPAIAPPVFVFQKDKGQKSPAEQKNLSDSGEEPRGEAEAPHHGTGHPESAGEHALEPPAPAGASASTPPPPAPEAQLPPFPRELAGRSAGGSSPEGGEDSDREDGNYCPP

SEQ ID NO: 71425 - protein, 171 aa, Homo sapiens
  Payload ID: 14138
  Gene Symbol: RANBP3
  Gene Name: RAN binding protein 3
  ENSP ID: ENSP00000466761
MADLANEEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYF

SEQ ID NO: 71426 - protein, 74 aa, Homo sapiens
  Payload ID: 14138
  Gene Symbol: RANBP3
  Gene Name: RAN binding protein 3
  ENSP ID: ENSP00000466879
MADLANEEKPAIAPPVFVFQKDKGQKRSAGGSSPEGGEDSDREDGNYCPPVKRERTSSLTQFPPSQSEENFWKE

SEQ ID NO: 71427 - protein, 62 aa, Homo sapiens
  Payload ID: 14138
  Gene Symbol: RANBP3
  Gene Name: RAN binding protein 3
  ENSP ID: ENSP00000466970
MADLANEEKPAIAPPVFVFQKDKGQKVRGRGQLAAPVLKAEKILTEKMEITALLSSEKEHPL

SEQ ID NO: 71428 - protein, 108 aa, Homo sapiens
  Payload ID: 14138
  Gene Symbol: RANBP3
  Gene Name: RAN binding protein 3
  ENSP ID: ENSP00000467560
MADLANEEKPAIAPPVFVFQKDKGQKSPAEQKNLSDSGEEPRGEAEAPHHGTGHPESAGEHALEPPAPAGASASTPPPPAPEAQLPPFPRELAGEEEKTLPLNPEGIP

SEQ ID NO: 71429 - protein, 38 aa, Homo sapiens
  Payload ID: 14138
  Gene Symbol: RANBP3
  Gene Name: RAN binding protein 3
  ENSP ID: ENSP00000467760
MADLANEDGVSPCWPGWSPSPDLVICPPRPPKVLGLQA

SEQ ID NO: 71430 - protein, 77 aa, Homo sapiens
  Payload ID: 14138
  Gene Symbol: RANBP3
  Gene Name: RAN binding protein 3
  ENSP ID: ENSP00000468211
MLHCRLTSGFEGRVLSLAKVKKTGKRKSLPLLRPSLCFRRIKDKRGQLAAPVLKAEKILTEKMEITALLSSEKEHPL

SEQ ID NO: 71431 - protein, 122 aa, Homo sapiens
  Payload ID: 14138
  Gene Symbol: RANBP3
  Gene Name: RAN binding protein 3
  ENSP ID: ENSP00000468815
MENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQ

SEQ ID NO: 71432 - protein, 465 aa, Homo sapiens
  Payload ID: 14139
  Gene Symbol: RANBP3L
  Gene Name: RAN binding protein 3-like
  Uniprot ID: Q86VV4
  ENSP ID: ENSP00000296604
MTTIPRKGSSHLPGSLHTCKLKLQEDRRQQEKSVIAQPIFVFEKGEQTFKRPAEDTLYEAAEPECNGFPTKRVRSSSFTFHITDSQSQGVRKNNVFMTSALVQSSVDIKSAEQGPVKHSKHVIRPAILQLPQARSCAKVRKTFGHKALESCKTKEKTNNKISEGNSYLLSENLSRARISVQLSTNQDFLGATSVGCQPNEDKCSFKSCSSNFVFGENMVERVLGTQKLTQPQLENDSYAKEKPFKSIPKFPVNFLSSRTDSIKNTSLIESAAAFSSQPSRKCLLEKIDVITGEETEHNVLKINCKLFIFNKTTQSWIERGRGTLRLNDTASTDCGTLQSRLIMRNQGSLRLILNSKLWAQMKIQRANHKNVRITATDLEDYSIKIFLIQASAQDTAYLYAAIHHRLVALQSFNKQRDVNQAESLSETAQQLNCESCDENEDDFIQVTKNGSDPSSWTHRQSVACS

SEQ ID NO: 71433 - protein, 321 aa, Homo sapiens
  Payload ID: 14139
  Gene Symbol: RANBP3L
  Gene Name: RAN binding protein 3-like
  Uniprot ID: Q86VV4
  ENSP ID: ENSP00000421149
MTTIPRKGSSHLPGSLHTCKLKLQEDRRQQEKSVIAQPIFVFEKGEQTFKRPAEDTLYEAAEPECNGFPTKRVRSSSFTFHITDSQSQGVRKNNVFMTSALVQSSVDIKSAEQGPVKHSKHVIRPAILQLPQARSCAKVRKTFGHKALESCKTKEKTNNKISEGNSYLLSENLSRARISVQLSTNQDFLGATSVGCQPNEDKCSFKSCSSNFVFGENMVERVLGTQKLTQPQLENDSYAKEKPFKSIPKFPVNFLSSRTDSIKNTSLIESAAAFSSQPSRKCLLEKIDVITGEETEHNVLKVCISCFTLSGSIYILGIKLT

SEQ ID NO: 71434 - protein, 490 aa, Homo sapiens
  Payload ID: 14139
  Gene Symbol: RANBP3L
  Gene Name: RAN binding protein 3-like
  Uniprot ID: Q86VV4
  ENSP ID: ENSP00000421853
MTTIPRKGSSHLPGSLHTCKLKLQEDRRQQEKSVIAQPIFVFEKGEQTFKRPAEDTLYEAAEPECNGFPTKRVRSSSFTFHITDSQSQGVSTLSQKQMRCSSVTNLPTFPHSGPVRKNNVFMTSALVQSSVDIKSAEQGPVKHSKHVIRPAILQLPQARSCAKVRKTFGHKALESCKTKEKTNNKISEGNSYLLSENLSRARISVQLSTNQDFLGATSVGCQPNEDKCSFKSCSSNFVFGENMVERVLGTQKLTQPQLENDSYAKEKPFKSIPKFPVNFLSSRTDSIKNTSLIESAAAFSSQPSRKCLLEKIDVITGEETEHNVLKINCKLFIFNKTTQSWIERGRGTLRLNDTASTDCGTLQSRLIMRNQGSLRLILNSKLWAQMKIQRANHKNVRITATDLEDYSIKIFLIQASAQDTAYLYAAIHHRLVALQSFNKQRDVNQAESLSETAQQLNCESCDENEDDFIQVTKNGSDPSSWTHRQSVACS

SEQ ID NO: 71435 - protein, 108 aa, Homo sapiens
  Payload ID: 14139
  Gene Symbol: RANBP3L
  Gene Name: RAN binding protein 3-like
  ENSP ID: ENSP00000427147
MTTIPRKGSSHLPGSLHTCKLKLQEDRRQQEKSVIAQPIFVFEKGEQTFKRPAEDTLYEAAEPECNGFPTKRVRSSSFTFHITDSQSQGVRKNNVFMTSALVQSSVDI

SEQ ID NO: 71436 - protein, 1105 aa, Homo sapiens
  Payload ID: 14140
  Gene Symbol: RANBP6
  Gene Name: RAN binding protein 6
  Uniprot ID: O60518
  ENSP ID: ENSP00000259569
MAATASAGVPATVSEKQEFYQLLKNLINPSCMVRRQAEEIYENIPGLCKTTFLLDAVRNRRAGYEVRQMAAALLRRLLSSGFEEVYPNLPADVQRDVKIELILAVKLETHASMRKKLCDIFAVLARNLIDEDGTNHWPEGLKFLIDSIYSKNVVLWEVALHVFWHFPGIFGTQERHDLDIIKRLLDQCIQDQEHPAIRTLSARAAAAFVLANENNIALFKDFADLLPGILQAVNDSCYQDDDSVLESLVEIADTVPKYLGPYLEDTLQLSLKLCGDSRLSNLQRQLALEVIVTLSETATPMLKKHTNIIAQAVPHILAMMVDLQDDEDWVNADEMEEDDFDSNAVAAESALDRLACGLGGKVVLPMTKEHIMQMLQSPDWKYRHAGLMALSAIGEGCHQQMESILDETVNSVLLFLQDPHPRVRAAACTTLGQMATDFAPNFQKKFHETVIAALLRTMENQGNQRVQSHAASALIIFIEDCPKSLLVLYVDSMVKNLHSVLVIKLQELIRNGTKLALEQLVTTIASVADTIEEKFVPYYDIFMPSLKHIVELAVQKELKLLRGKTIECISHIGLAVGKEKFMQDASNVMQLLLKTQSDLNNMEDDDPQTSYMVSAWARMCKILGKDFQQYLPLVIEPLIKTASAKPDVALLDTQDVENMSDDDGWQFVNLGDQQSFGIKTSGLEAKATACQMLVYYAKELREGFVEYTEQVVKLMVPLLKFYFHDNVRVAAAESMPFLLECARIRGPEYLAQMWQFICDPLIKAIGTEPDTDVLSEIMNSFAKSIEVMGDGCLNDEHLEELGGILKAKLEGHFKNQELRQVKRQEENYDQQVEMSLQDEDECDVYILTKVSDILHSLFSTYKEKILPWFEQLLPLIVNLICSSRPWPDRQWGLCIFDDIIEHCSPTSFKYVEYFRWPMLLNMRDNNPEVRQAAAYGLGVMAQFGGDDYRSLCSEAVPLLVKVIKCANSKTKKNVIATENCISAIGKILKFKPNCVNVDEVLPHWLSWLPLHEDKEEAIQTLSFLCDLIESNHPVVIGPNNSNLPKIISIIAEGKINETINYEDPCAKRLANVVRQVQTSEDLWLECVSQLDDEQQEALQELLNFA

SEQ ID NO: 71437 - protein, 68 aa, Homo sapiens
  Payload ID: 14140
  Gene Symbol: RANBP6
  Gene Name: RAN binding protein 6
  ENSP ID: ENSP00000485188
MAATASAGVPATVSEKQEFYQLLKNLINPSCMVRRQAEEIYENIPGSSSKGEGCSLYYTWTDGYRFCT

SEQ ID NO: 71438 - protein, 228 aa, Homo sapiens
  Payload ID: 14140
  Gene Symbol: RANBP6
  Gene Name: RAN binding protein 6
  ENSP ID: ENSP00000485482
MAATASAGVPATVSEKQEFYQLLKNLINPSCMVRRQAEEIYENIPGLCKTTFLLDAVRNRRAGYEDPHPRVRAAACTTLGQMATDFAPNFQKKFHETVIAALLRTMENQGNQRVQSHAASALIIFIEDCPKSLLVLYVDSMVKNLHSVLVIKLQELIRNGTKLALEQLVTTIASVADTIEEKFVPYYDIFMPSLKHIVELAVQKELKLLRGKTIECISHIGLAVGKEK

SEQ ID NO: 71439 - protein, 729 aa, Homo sapiens
  Payload ID: 14141
  Gene Symbol: RANBP9
  Gene Name: RAN binding protein 9
  Uniprot ID: Q96S59
  ENSP ID: ENSP00000011619
MSGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLKVRQFIEMVNGTDSEVRCLGGRSPKSQDSYPVSPRPFSSPSMSPSHGMNIHNLASGKGSTAHFSGFESCSNGVISNKAHQSYCHSNKHQSSNLNVPELNSINMSRSQQVNNFTSNDVDMETDHYSNGVGETSSNGFLNGSSKHDHEMEDCDTEMEVDSSQLRRQLCGGSQAAIERMIHFGRELQAMSEQLRRDCGKNTANKKMLKDAFSLLAYSDPWNSPVGNQLDPIQREPVCSALNSAILETHNLPKQPPLALAMGQATQCLGLMARSGIGSCAFATVEDYLH

SEQ ID NO: 71440 - protein, 587 aa, Homo sapiens
  Payload ID: 14142
  Gene Symbol: RANGAP1
  Gene Name: Ran GTPase activating protein 1
  Uniprot ID: P46060
  ENSP ID: ENSP00000348577
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 71441 - protein, 587 aa, Homo sapiens; identical to SEQ ID NO: 71440
  Payload ID: 14142
  Gene Symbol: RANGAP1
  Gene Name: Ran GTPase activating protein 1
  Uniprot ID: P46060
  ENSP ID: ENSP00000385866

SEQ ID NO: 71442 - protein, 253 aa, Homo sapiens
  Payload ID: 14142
  Gene Symbol: RANGAP1
  Gene Name: Ran GTPase activating protein 1
  ENSP ID: ENSP00000393407
  MOD_RES (1)..(1): Any amino acid
XVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASL

SEQ ID NO: 71443 - protein, 133 aa, Homo sapiens
  Payload ID: 14142
  Gene Symbol: RANGAP1
  Gene Name: Ran GTPase activating protein 1
  ENSP ID: ENSP00000394787
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFE

SEQ ID NO: 71444 - protein, 587 aa, Homo sapiens; identical to SEQ ID NO: 71440
  Payload ID: 14142
  Gene Symbol: RANGAP1
  Gene Name: Ran GTPase activating protein 1
  Uniprot ID: P46060
  ENSP ID: ENSP00000401470

SEQ ID NO: 71445 - protein, 37 aa, Homo sapiens
  Payload ID: 14142
  Gene Symbol: RANGAP1
  Gene Name: Ran GTPase activating protein 1
  ENSP ID: ENSP00000404842
MASEDIAKLAETLAKTQVAGGQLSFKGKSLKLNTAED

SEQ ID NO: 71446 - protein, 100 aa, Homo sapiens
  Payload ID: 14142
  Gene Symbol: RANGAP1
  Gene Name: Ran GTPase activating protein 1
  ENSP ID: ENSP00000408743
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPAL

SEQ ID NO: 71447 - protein, 186 aa, Homo sapiens [sequence omitted]

SEQ ID NO: 71448 - protein, 146 aa, Homo sapiens
  Payload ID: 14143
  Gene Symbol: RANGRF
  Gene Name: RAN guanine nucleotide release factor
  Uniprot ID: Q9HD47
  ENSP ID: ENSP00000383940
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQVAKDVTLHQALLRLPQYQTDLLLTFNQPP

SEQ ID NO: 71449 - protein, 165 aa, Homo sapiens
  Payload ID: 14143
  Gene Symbol: RANGRF
  Gene Name: RAN guanine nucleotide release factor
  Uniprot ID: Q9HD47
  ENSP ID: ENSP00000413190
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQVRARECVMSWKGGSGDAEIQVSILTLIPLGSKGRDTSSGLAEAAPVPD

SEQ ID NO: 71450 - protein, 118 aa, Homo sapiens
  Payload ID: 14143
  Gene Symbol: RANGRF
  Gene Name: RAN guanine nucleotide release factor
  Uniprot ID: Q9HD47
  ENSP ID: ENSP00000462310
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQP

SEQ ID NO: 71451 - protein, 233 aa, Homo sapiens
  Payload ID: 14144
  Gene Symbol: RAN
  Gene Name: RAN, member RAS oncogene family
  ENSP ID: ENSP00000376174
MAAQGEPQVQFKLVLVGDGGTGKTTFVKRHLTGEFEKKYVATLGVEVHPLVFHTNRGPIKFNVWDTAGQEKFGGLRDGYYIQEMGIHHVAHAGLELMSSAQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 71452 - protein, 216 aa, Homo sapiens
  Payload ID: 14144
  Gene Symbol: RAN
  Gene Name: RAN, member RAS oncogene family
  Uniprot ID: P62826
  ENSP ID: ENSP00000376176
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 71453 - protein, 234 aa, Homo sapiens
  Payload ID: 14144
  Gene Symbol: RAN
  Gene Name: RAN, member RAS oncogene family
  ENSP ID: ENSP00000396127
RRRRLRLRRLNCASAIFPASVGRARRRFWKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 71454 - protein, 103 aa, Homo sapiens
  Payload ID: 14144
  Gene Symbol: RAN
  Gene Name: RAN, member RAS oncogene family
  ENSP ID: ENSP00000437950
  MOD_RES (1)..(1): Any amino acid
XLRLRRLNCASAIFPASVGRARRRFWKLVLVGDGGTGKTTFVKRHLTGEFEKKYVATLGVEVHPLVFHTNRGPIKFNVWDTAGQEKFGGLRDGYYIQVCHHNV

SEQ ID NO: 71455 - protein, 128 aa, Homo sapiens
  Payload ID: 14144
  Gene Symbol: RAN
  Gene Name: RAN, member RAS oncogene family
  ENSP ID: ENSP00000441210
MFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLEVAQTTALPDEDDDL

SEQ ID NO: 71456 - protein, 198 aa, Homo sapiens
  Payload ID: 14144
  Gene Symbol: RAN
  Gene Name: RAN, member RAS oncogene family
  ENSP ID: ENSP00000444042
MAAQGEPQLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDIKDRKVKAKSIVFHRKKNLQYYDISAKSNYNFEKPFLWLARKLIGDPNLEFVAMPALAPPEVVMDPALAAQYEHDLE

SEQ ID NO: 71457 - protein, 216 aa, Homo sapiens; identical to SEQ ID NO: 71452
  Payload ID: 14144
  Gene Symbol: RAN
  Gene Name: RAN, member RAS oncogene family
  Uniprot ID: P62826
  ENSP ID: ENSP00000446215

SEQ ID NO: 71458 - protein, 53 aa, Homo sapiens
  Payload ID: 14144
  Gene Symbol: RAN
  Gene Name: RAN, member RAS oncogene family
  ENSP ID: ENSP00000483687
MAAQGEPQVQFKPSSGLLGSSLETLTWNLLPCLLSPHQKLSWTQLWQHSMSTT

SEQ ID NO: 71459 - protein, 1756 aa, Homo sapiens
  Payload ID: 14145
  Gene Symbol: RGPD1
  Gene Name: RANBP2-like and GRIP domain containing 1
  ENSP ID: ENSP00000381253
MRRSKAYGERYLASVQGSAPSPGKKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHRAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 71460 - protein, 1748 aa, Homo sapiens
  Payload ID: 14145
  Gene Symbol: RGPD1
  Gene Name: RANBP2-like and GRIP domain containing 1
  Uniprot ID: P0DJD0
  ENSP ID: ENSP00000386808
MNVMGFNTDRLAWTRNKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHRAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 71461 - protein, 31 aa, Homo sapiens
  Payload ID: 14145
  Gene Symbol: RGPD1
  Gene Name: RANBP2-like and GRIP domain containing 1
  ENSP ID: ENSP00000402729
  MOD_RES (1)..(1): Any amino acid
XHGNIEDAVTAFESIKSVVSYWNLALESRRH

SEQ ID NO: 71462 - protein, 1748 aa, Homo sapiens; identical to SEQ ID NO: 71460
  Payload ID: 14145
  Gene Symbol: RGPD1
  Gene Name: RANBP2-like and GRIP domain containing 1
  Uniprot ID: P0DJD0
  ENSP ID: ENSP00000453170

SEQ ID NO: 71463 - protein, 1756 aa, Homo sapiens
  Payload ID: 14146
  Gene Symbol: RGPD2
  Gene Name: RANBP2-like and GRIP domain containing 2
  Uniprot ID: P0DJD1
  ENSP ID: ENSP00000381214
MRRSKAYGERYLASVQGSAPSPGKKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 71464 - protein, 1760 aa, Homo sapiens
  Payload ID: 14147
  Gene Symbol: RGPD3
  Gene Name: RANBP2-like and GRIP domain containing 3
  ENSP ID: ENSP00000303659
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAEYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGGPLYKNGSLRNADSEIKHSTPSPTKYSLSPSKSYKYSPKTPPRWAEDQNSLLKMIRQEVKAIKKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKSEKPLENDTGLQAQDISGRKKGRGVIFGQTSSTFTFADVAKSTSGEGFQFGKKDLNFKGFSGAGEKLFSSQYGKMANKANTSGDFEKDDDAYKTEDSDDIHFEPVVQMPEKVELVTGEEGEKVLYSQGVKLFRFDAEVSQWKERGLGNLKILKNEVNGKVRMLMQREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVAEEENKGSGTGAAGASDTTIKPNAENTGPTLEWDNYDLREDALDDSVSSSSVHASPLASSPVRKNLFHFDESTTGSNFSFKSALSLSKSPAKLNQSGTSVGTDEESDVTQEEERDGQYFEPVVPLPDLVEVSSGEENEQVVFSHRAEFYRYDKDVGQWKERGIGDIKILQNYDNKHVRILMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWYAEFTKEELVQKLSSTTKSADHLNGLLREIEATNAVLMEQIKLLKSEIRRLERNQEQEVSAANVEHLKNVLLQFIFLKPGSERERLLPVINTMLQLSLEEKGKLAAVAQGLQETSIPKKK

SEQ ID NO: 71465 - protein, 1758 aa, Homo sapiens
  Payload ID: 14147
  Gene Symbol: RGPD3
  Gene Name: RANBP2-like and GRIP domain containing 3
  Uniprot ID: A6NKT7
  ENSP ID: ENSP00000386588
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAEYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGGPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKSEKPLENDTGLQAQDISGRKKGRGVIFGQTSSTFTFADVAKSTSGEGFQFGKKDLNFKGFSGAGEKLFSSQYGKMANKANTSGDFEKDDDAYKTEDSDDIHFEPVVQMPEKVELVTGEEGEKVLYSQGVKLFRFDAEVSQWKERGLGNLKILKNEVNGKVRMLMQREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVAEEENKGSGTGAAGASDTTIKPNAENTGPTLEWDNYDLREDALDDSVSSSSVHASPLASSPVRKNLFHFDESTTGSNFSFKSALSLSKSPAKLNQSGTSVGTDEESDVTQEEERDGQYFEPVVPLPDLVEVSSGEENEQVVFSHRAEFYRYDKDVGQWKERGIGDIKILQNYDNKHVRILMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWYAEFTKEELVQKLSSTTKSADHLNGLLREIEATNAVLMEQIKLLKSEIRRLERNQEQEVSAANVEHLKNVLLQFIFLKPGSERERLLPVINTMLQLSLEEKGKLAAVAQGEE

SEQ ID NO: 71466 - protein, 1758 aa, Homo sapiens
  Payload ID: 14148
  Gene Symbol: RGPD4
  Gene Name: RANBP2-like and GRIP domain containing 4
  Uniprot ID: Q7Z3J3
  ENSP ID: ENSP00000386810
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGDPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKESEKPLENDTGFQAQDISGQKNGRGVIFGQTSSTFTFADVAKSTSGEGFQFGKKDPNFKGFSGAGEKLFSSQCGKMANKANTSGDFEKDDDAYKTEDSDDIHFEPVVQMPEKVELVIGEEGEKVLYSQGVKLFRFDAEVRQWKERGLGNLKILKNEVNGKPRMLMRREQVLKVCANHWITTTMNLKPLSGSDRAWMWSASDFSDGDAKLERLAAKFKTPELAEEFKQKFEECQQLLLDIPLQTPHKLVDTGRAAKLIQRAEEMKSGLKDFKTFLTNDQTKVTEEENKGSGTGAAGASDTTIKPNPENTGPTLEWDNCDLREDALDDSVSSSSVHASPLASSPVRKNLFHFGESTTGSNFSFKSALSPSKSPAKLNQSGTSVGTDEESDVTQEEERDGQYFEPVVPLPDLVEVSSGEENEKVVFSHRAELYRYDKDVGQWKERGIGDIKILQNYDNKQVRIVMRRDQVLKLCANHTITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNASLKSNNSETSSVAQSGSESKVEPKKCELSKNSDIEQSSDSKVKNLSASFPMEESSINYTFKTPEKEPPLWHAEFTKEELVQKLSSTTKSADHLNGLLREAEATSAVLMEQIKLLKSEIRRLERNQEQEESAANVEHLKNVLLQFIFLKPGSERERLLPVINTMLQLSPEEKGKLAAVAQGEE

SEQ ID NO: 71467 - protein, 1765 aa, Homo sapiens
  Payload ID: 14149
  Gene Symbol: RGPD5
  Gene Name: RANBP2-like and GRIP domain containing 5
  Uniprot ID: Q99666
  ENSP ID: ENSP00000016946
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGFQAQDISGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGAAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAILEETTRERTDVIQGDDVADAASEVEVSSTSETTTKAVVSPPKFVFVSESVKRIFSSEKSKPFVFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENASRSSG

SEQ ID NO: 71468 - protein, 904 aa, Homo sapiens
  Payload ID: 14149
  Gene Symbol: RGPD5
  Gene Name: RANBP2-like and GRIP domain containing 5
  Uniprot ID: Q99666
  ENSP ID: ENSP00000272454
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWQATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAMLDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTEAAHRHFTIEKHGDSKWIIYRFTKQLCGTERARAKIS

SEQ ID NO: 71469 - protein, 904 aa, Homo sapiens; identical to SEQ ID NO: 71468
  Payload ID: 14149
  Gene Symbol: RGPD5
  Gene Name: RANBP2-like and GRIP domain containing 5
  Uniprot ID: Q99666
  ENSP ID: ENSP00000376962

SEQ ID NO: 71470 - protein, 134 aa, Homo sapiens
  Payload ID: 14149
  Gene Symbol: RGPD5
  Gene Name: RANBP2-like and GRIP domain containing 5
  ENSP ID: ENSP00000392556
MRRSKADVERYVASVLGLTPSPRQSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLK

SEQ ID NO: 71471 - protein, 56 aa, Homo sapiens
  Payload ID: 14149
  Gene Symbol: RGPD5
  Gene Name: RANBP2-like and GRIP domain containing 5
  ENSP ID: ENSP00000400797
MKGFYFAKLYYEAKEYDLAKKYICTYINVQERDPKAHRFLGLLYELEENTEKAVEC

SEQ ID NO: 71472 - protein, 98 aa, Homo sapiens
  Payload ID: 14149
  Gene Symbol: RGPD5
  Gene Name: RANBP2-like and GRIP domain containing 5
  ENSP ID: ENSP00000409406
YWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKF

SEQ ID NO: 71473 - protein, 152 aa, Homo sapiens
  Payload ID: 14149
  Gene Symbol: RGPD5
  Gene Name: RANBP2-like and GRIP domain containing 5
  ENSP ID: ENSP00000411548
MWSGTSPRCWVSPRRLDRYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRL

SEQ ID NO: 71474 - protein, 904 aa, Homo sapiens; identical to SEQ ID NO: 71468
  Payload ID: 14150
  Gene Symbol: RGPD6
  Gene Name: RANBP2-like and GRIP domain containing 6
  Uniprot ID: Q99666
  ENSP ID: ENSP00000330023

SEQ ID NO: 71475 - protein, 1765 aa, Homo sapiens; identical to SEQ ID NO: 71467
  Payload ID: 14150
  Gene Symbol: RGPD6
  Gene Name: RANBP2-like and GRIP domain containing 6
  Uniprot ID: Q99666
  ENSP ID: ENSP00000330842

SEQ ID NO: 71476 - protein, 202 aa, Homo sapiens
  Payload ID: 14150
  Gene Symbol: RGPD6
  Gene Name: RANBP2-like and GRIP domain containing 6
  ENSP ID: ENSP00000387779
  MOD_RES (1)..(1): Any amino acid
XFDEAKTAQEKDSLITPHVSRSSTPRESPCGKIAVAILEETTRERTDVIQGDDVADAASEVEVSSTSETTTKAVVSPPKFVFVSESVKRIFSSEKSKPFVFGNSSATGSLFGFSFNAPLKSNNSETSSVAQSGSESKVEPKKCELSKNSDIEQSSDSKVKNLSASFPTEESSINYTFKTPEKGFNFSLFKSNPMAFWTSTPS

SEQ ID NO: 71477 - protein, 56 aa, Homo sapiens; identical to SEQ ID NO: 71471
  Payload ID: 14150
  Gene Symbol: RGPD6
  Gene Name: RANBP2-like and GRIP domain containing 6
  ENSP ID: ENSP00000409424

SEQ ID NO: 71478 - protein, 135 aa, Homo sapiens
  Payload ID: 14150
  Gene Symbol: RGPD6
  Gene Name: RANBP2-like and GRIP domain containing 6
  ENSP ID: ENSP00000410084
MRRSKADVERYVASVLGLTPSPRQSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKE

SEQ ID NO: 71479 - protein, 98 aa, Homo sapiens; identical to SEQ ID NO: 71472
  Payload ID: 14150
  Gene Symbol: RGPD6
  Gene Name: RANBP2-like and GRIP domain containing 6
  ENSP ID: ENSP00000418549

SEQ ID NO: 71480 - protein, 1765 aa, Homo sapiens
  Payload ID: 14151
  Gene Symbol: RGPD8
  Gene Name: RANBP2-like and GRIP domain containing 8
  Uniprot ID: O14715
  ENSP ID: ENSP00000306637
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWRATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAILDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGLQAQDIRGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEEITRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENPSRSSG

SEQ ID NO: 71481 - protein, 904 aa, Homo sapiens
  Payload ID: 14151
  Gene Symbol: RGPD8
  Gene Name: RANBP2-like and GRIP domain containing 8
  ENSP ID: ENSP00000327486
MRRSKADVERYVASVLGLTPSPRQKSMKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKEYLESLQCLESDKSDWRATNTDLLLAYANLMLLTLSTRDVQENRELLESFDSALQSAKSSLGGNDELSATFLEMKGHFYMYAGSLLLKMGQHGNNVQWRALSELAALCYLIAFQVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAILDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTEAAHRHFTIEKHGDSKWIIYRFTKQLCGTERARAKIS

SEQ ID NO: 71482 - protein, 1625 aa, Homo sapiens
  Payload ID: 14151
  Gene Symbol: RGPD8
  Gene Name: RANBP2-like and GRIP domain containing 8
  ENSP ID: ENSP00000386511
MKGFYFAKLYYEAKEYDLAKKYICTYINVQERDPKAHRFLGLLYELEENTEKAVECYRRSVELNPTQKDLVLKIAELLCKNDVTDGRAKYWVERAAKLFPGSPAIYKLKEQLLDCEGEDGWNKLFDLIQSELYVRPDDVHVNIRLVELYRSTKRLKDAVAHCHEAERNIALRSSLEWNSCVVQTLKVPRPKIKLREGKAGQNLLEMMACDRLSQSGHMLLSLSRGKQDFLKEVVETFANKIGQSALYDALFSSQSPKDTSFLGSDDIGKIDVQEPELEDLARYDVGAIRAHNGSLQHLTWLGLQWNSLPALPGIRKWLKQLFHRLPHETSRLETNAPESICILDLEVFLLGVVYTSHLQLKEKCNSHHSSYQPLCLPFPVCKQLCTERQKSWWDAVCTLIHRKAVPGNLAKLRLLVQHEINTLRAQEKHGLQPALLVHWAKYLQKTGSGLNSFYGQLEYIGRSVHYWKKVLPLLKIIKKNSIPEPIDPLFKHFHSVDIQASEIVEYEEDAHITFAILDAVNGNIEDAVTAFESIKSVVSYWNLALIFHRKAEDIENDALSPEEQEECRNYLTKTRDYLIKIIDDGDSNLSVVKKLPVPLESVKQMLNSVMQELEDYSEGGPLYKNGSLRNADSEIKHSTPSPTKYSLSPSKSYKYSPETPPRWTEDRNSLLNMICQQVEAIKKEMQELKLNSSKSASRHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKREKPLENDTGLQAQDIRGRKKGRGVIFGQTSSTFTFADVAKSTSGEGFQFGKKDLNFKGFSGAGEKLFSSRYGKMANKANTSGDFEKDDDAYKTEDSDDIHFEPVVQMPEKVELVTGEEGEKVLYSQGVKLFRFDAEVRQWKERGLGNLKILKNEVNGKLRMLMRREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVTEEENKGSGTGVAGASDTTIKPNAENTGPTLEWDNYDLREDALDDSVSSSSVHASPLASSPVRKNLFRFDESTTGSNFSFKSALSLSKSPAKLNQSGTSVGTDEESVVTQEEERDGQYFEPVVPLPDLVEVSSGEENEQVVFSHRAEIYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEEITRERTDVIQGDDVADAASEVEVSSTSETTTKAVVSPPKFVFVSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWHAEFTKEELVQKLRSTTKSADHLNGLLREIEATNAVLMEQIKLLKSEIRRLERNQEREKSAANLEYLKNVLLQFIFLKPGSERERLLPVINTMLQLSPEEKGKLAAVAQDEEENPSRSSG

SEQ ID NO: 71483 - protein, 98 aa, Homo sapiens; identical to SEQ ID NO: 71472
  Payload ID: 14151
  Gene Symbol: RGPD8
  Gene Name: RANBP2-like and GRIP domain containing 8
  ENSP ID: ENSP00000429923

SEQ ID NO: 71484 - protein, 152 aa, Homo sapiens; identical to SEQ ID NO: 71473
  Payload ID: 14151
  Gene Symbol: RGPD8
  Gene Name: RANBP2-like and GRIP domain containing 8
  ENSP ID: ENSP00000430052

SEQ ID NO: 71485 - protein, 468 aa, Homo sapiens
  Payload ID: 14152
  Gene Symbol: RBCK1
  Gene Name: RanBP-type and C3HC4-type zinc finger containing 1
  Uniprot ID: Q9BYM8
  ENSP ID: ENSP00000254960
MGTATPDGREDQERLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 71486 - protein, 510 aa, Homo sapiens
  Payload ID: 14152
  Gene Symbol: RBCK1
  Gene Name: RanBP-type and C3HC4-type zinc finger containing 1
  Uniprot ID: Q9BYM8
  ENSP ID: ENSP00000348632
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRECLHTFCRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 71487 - protein, 340 aa, Homo sapiens
  Payload ID: 14152
  Gene Symbol: RBCK1
  Gene Name: RanBP-type and C3HC4-type zinc finger containing 1
  ENSP ID: ENSP00000371616
MGCGRMGTVPTSICCQPATPPSTLRSCSGSGSCGCWKIWASRTSRCSRGALWSQAPQSPGSPRNPDGGSQMQCLSPHRWAGSAPGAPSSTSPRGLAVRCAAGRAPRPTRSPPHTSPTRRSERAWRARRRRCVSTSRECLQGTIRNSQEAEVSCPFIDNTYSCSGKLLEREIKALLTPEDYQRFLDLGISIAENRSAFSYHCKTPDCKGWCFFEDDVNEFTCPVCFHVNCLLCKAIHEQMNCKEYQEDLALRAQNDVAARQTTEMLKVMLQQGEAMRCPQCQIVVQKKDGCDWIRCTVCHTEICWVTKGPRWGPGGPGDTSGGCRCRVNGIPCHPSCQNCH

SEQ ID NO: 71488 - protein, 336 aa, Homo sapiens
  Payload ID: 14152
  Gene Symbol: RBCK1
  Gene Name: RanBP-type and C3HC4-type zinc finger containing 1
  ENSP ID: ENSP00000371649
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQRKQQQQEGNYLQHVQLDQRSLVLNTEPAECPVCYSVLAPGEAVVLRSACRAPSATARRRRSPAPSLTTPTRARASCWRGRSRRS

SEQ ID NO: 71489 - protein, 63 aa, Homo sapiens
  Payload ID: 14152
  Gene Symbol: RBCK1
  Gene Name: RanBP-type and C3HC4-type zinc finger containing 1
  ENSP ID: ENSP00000383106
MGTATPDGREDQERFLMVQNGHSSSIQPSHHRRKGRKTPLHTLLKSIAQKLYTLLPLIPVDQN

SEQ ID NO: 71490 - protein, 116 aa, Homo sapiens
  Payload ID: 14152
  Gene Symbol: RBCK1
  Gene Name: RanBP-type and C3HC4-type zinc finger containing 1
  ENSP ID: ENSP00000387799
MDEKTKKEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSH

SEQ ID NO: 71491 - protein, 255 aa, Homo sapiens
  Payload ID: 14152
  Gene Symbol: RBCK1
  Gene Name: RanBP-type and C3HC4-type zinc finger containing 1
  ENSP ID: ENSP00000393841
  MOD_RES (1)..(1): Any amino acid
XEMALSLTRAVAGGDEQVAMKCAIWLAEQRVPLSVQLKPEVSPTQDIRSRGEKTEEVGEVREVPDHGGPRVLPRVDSKSSVEPLEGPNWLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPE

SEQ ID NO: 71492 - protein, 272 aa, Homo sapiens
  Payload ID: 14152
  Gene Symbol: RBCK1
  Gene Name: RanBP-type and C3HC4-type zinc finger containing 1
  ENSP ID: ENSP00000405288
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSHGVRQNGDSAYLYLLSARNTSLNPQELQRERQLRMLEDLGFKDLTLQPRGPLEPGPPKPGVPQEPGRGQPDAVPEPPPVGWQCPGCTFINKPTRPGCEMCCRARPEAYQVPASYQPDEEERARLAGEEEALRQYQQGVPAGHHPQQPGGGGLLPLH

SEQ ID NO: 71493 - protein, 117 aa, Homo sapiens
  Payload ID: 14152
  Gene Symbol: RBCK1
  Gene Name: RanBP-type and C3HC4-type zinc finger containing 1
  ENSP ID: ENSP00000415080
MDEKTKKAEEMALSLTRAVAGGDEQVAMKCAIWLAEQRVPLSVQLKPEVSPTQDIRLWVSVEDAQMHTVTIWLTVRPDMTVASLKDMVFLDYGFPPVLQQWVIGQRLARDQETLHSH

SEQ ID NO: 71494 - protein, 105 aa, Homo sapiens
  Payload ID: 14152
  Gene Symbol: RBCK1
  Gene Name: RanBP-type and C3HC4-type zinc finger containing 1
  ENSP ID: ENSP00000417173
MDEKTKKAEEMALSLTRAVAGGDEQVAMKCAIWLAEQRVPLSVQLKPEVSPTQDIRFLMVQNGHSSSIQPSHHRRKGRKTPLHTLLKSIAQKLYTLLPLIPVDQN

SEQ ID NO: 71495 - protein, 1077 aa, Homo sapiens
  Payload ID: 14153
  Gene Symbol: RAPGEF1
  Gene Name: Rap guanine nucleotide exchange factor (GEF) 1
  Uniprot ID: Q13905
  ENSP ID: ENSP00000361263
MDTDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 71496 - protein, 1095 aa, Homo sapiens
  Payload ID: 14153
  Gene Symbol: RAPGEF1
  Gene Name: Rap guanine nucleotide exchange factor (GEF) 1
  Uniprot ID: Q13905
  ENSP ID: ENSP00000361264
MGNAIEKQKPLKRSHLYPWKQDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 71497 - protein, 1094 aa, Homo sapiens
  Payload ID: 14153
  Gene Symbol: RAPGEF1
  Gene Name: Rap guanine nucleotide exchange factor (GEF) 1
  Uniprot ID: Q13905
  ENSP ID: ENSP00000361269
MSGGLGLRRSPEMSGKIEKADSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 71498 - protein, 228 aa, Homo sapiens
  Payload ID: 14153
  Gene Symbol: RAPGEF1
  Gene Name: Rap guanine nucleotide exchange factor (GEF) 1
  ENSP ID: ENSP00000394296
  MOD_RES (1)..(1): Any amino acid
XLPEKKNKHMLAYMQLLEDYSEPQPSMFYQTPQNEHIYQQKNKLLMEVYGFSDSFSGVDSVQELAPPPALPPKQRQLQASCAASSFSSVSHCVQQTKVAFTPEDGSAAQGLSVSVSNSFLSRHGSLPVPSYKSVFRSYSQDFVPHHQASVPPFLPPTSSSSPHFPPAHQSQSSDLAVPTMAGPPPSTVDGPLSASQESSFHGNTVCLPSETSFTDSEPPAGKDGHPRD

SEQ ID NO: 71499 - protein, 319 aa, Homo sapiens
  Payload ID: 14153
  Gene Symbol: RAPGEF1
  Gene Name: Rap guanine nucleotide exchange factor (GEF) 1
  ENSP ID: ENSP00000407210
  MOD_RES (1)..(1): Any amino acid
XLAPPPALPPKQRQLSENASEEAGEGEYVNLYSSGQSSEELAPSRGEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSY

SEQ ID NO: 71500 - protein, 158 aa, Homo sapiens
  Payload ID: 14153
  Gene Symbol: RAPGEF1
  Gene Name: Rap guanine nucleotide exchange factor (GEF) 1
  ENSP ID: ENSP00000410640
MSGGLGLRRSPEMSGKIEKADSQRSHLSSFTMKLMDKFHSPKIKRTPSKKGKPAEVSVKIPEKPVNKNLSWLEEKEKEVVSALRYFKTIVDKMAIDKKVLEMLPGSASKVLEAILPLVQNDPRIQHSSALSSCYSRVYQSLANLIRWSDQVMLEGVNS

SEQ ID NO: 71501 - protein, 1499 aa, Homo sapiens
  Payload ID: 14154
  Gene Symbol: RAPGEF2
  Gene Name: Rap guanine nucleotide exchange factor (GEF) 2
  Uniprot ID: Q9Y4G8
  ENSP ID: ENSP00000264431
MKPLAIPANHGVMGQQEKHSLPADFTKLHLTDSLHPQVTHVSSSHSGCSITSDSGSSSLSDIYQATESEAGDMDLSGLPETAVDSEDDDDEEDIERASDPLMSRDIVRDCLEKDPIDRTDDDIEQLLEFMHQLPAFANMTMSVRRELCAVMVFAVVERAGTIVLNDGEELDSWSVILNGSVEVTYPDGKAEILCMGNSFGVSPTMDKEYMKGVMRTKVDDCQFVCIAQQDYCRILNQVEKNMQKVEEEGEIVMVKEHRELDRTGTRKGHIVIKGTSERLTMHLVEEHSVVDPTFIEDFLLTYRTFLSSPMEVGKKLLEWFNDPSLRDKVTRVVLLWVNNHFNDFEGDPAMTRFLEEFENNLEREKMGGHLRLLNIACAAKAKRRLMTLTKPSREAPLPFILLGGSEKGFGIFVDSVDSGSKATEAGLKRGDQILEVNGQNFENIQLSKAMEILRNNTHLSITVKTNLFVFKELLTRLSEEKRNGAPHLPKIGDIKKASRYSIPDLAVDVEQVIGLEKVNKKSKANTVGGRNKLKKILDKTRISILPQKPYNDIGIGQSQDDSIVGLRQTKHIPTALPVSGTLSSSNPDLLQSHHRILDFSATPDLPDQVLRVFKADQQSRYIMISKDTTAKEVVIQAIREFAVTATPDQYSLCEVSVTPEGVIKQRRLPDQLSKLADRIQLSGRYYLKNNMETETLCSDEDAQELLRESQISLLQLSTVEVATQLSMRNFELFRNIEPTEYIDDLFKLRSKTSCANLKRFEEVINQETFWVASEILRETNQLKRMKIIKHFIKIALHCRECKNFNSMFAIISGLNLAPVARLRTTWEKLPNKYEKLFQDLQDLFDPSRNMAKYRNVLNSQNLQPPIIPLFPVIKKDLTFLHEGNDSKVDGLVNFEKLRMIAKEIRHVGRMASVNMDPALMFRTRKKKWRSLGSLSQGSTNATVLDVAQTGGHKKRVRRSSFLNAKKLYEDAQMARKVKQYLSNLELEMDEESLQTLSLQCEPATNTLPKNPGDKKPVKSETSPVAPRAGSQQKAQSLPQPQQQPPPAHKINQGLQVPAVSLYPSRKKVPVKDLPPFGINSPQALKKILSLSEEGSLERHKKQAEDTISNASSQLSSPPTSPQSSPRKGYTLAPSGTVDNFSDSGHSEISSRSSIVSNSSFDSVPVSLHDERRQRHSVSIVETNLGMGRMERRTMIEPDQYSLGSYAPMSEGRGLYATATVISSPSTEELSQDQGDRASLDAADSGRGSWTSCSSGSHDNIQTIQHQRSWETLPFGHTHFDYSGDPAGLWASSSHMDQIMFSDHSTKYNRQNQSRESLEQAQSRASWASSTGYWGEDSEGDTGTIKRRGGKDVSIEAESSSLTSVTTEETKPVPMPAHIAVASSTTKGLIARKEGRYREPPPTPPGYIGIPITDFPEGHSHPARKPPDYNVALQRSRMVARSSDTAGPSSVQQPHGHPTSSRPVNKPQWHKPNESDPRLAPYQSQGFSTEEDEDEQVSAV

SEQ ID NO: 71502 - protein, 265 aa, Homo sapiens
  Payload ID: 14154
  Gene Symbol: RAPGEF2
  Gene Name: Rap guanine nucleotide exchange factor (GEF) 2
  ENSP ID: ENSP00000421083
  MOD_RES (1)..(1): Any amino acid
XDAQMARKVKQYLSNLELEMDEESLQTLSLQCEPATNTLPKNPGDKKPVKSETSPVAPRAGSQQKAQSLPQPQQQPPPAHKINQGLQVPAVSLYPSRKKVPVKDLPPFGINSPQALKKILSLSEEGSLERHKKQAEDTISNASSQLSSPPTSPQSSPRKGGSGNQLRSFGSGQLDLTSSSSSLGSYTLAPSGTVDNFSDSGHSEISSRSSIVSNSSFDSVPVSLHDERRQRHSVSIVETNLGMGRMERRTMIEPDQYSLGSYAPM

SEQ ID NO: 71503 - protein, 116 aa, Homo sapiens
  Payload ID: 14154
  Gene Symbol: RAPGEF2
  Gene Name: Rap guanine nucleotide exchange factor (GEF) 2
  ENSP ID: ENSP00000421602
MDLSGLPETAVDSEDDDDEEDIERASDPLMSRDIVRDCLEKDPIDRTDDDIEQLLEFMHQLPAFANMTMSVRRELCAVMVFAVVERAGTIVLNDGEELDSWSVILNGSVEVTYPDG

SEQ ID NO: 71504 - protein, 189 aa, Homo sapiens
  Payload ID: 14154
  Gene Symbol: RAPGEF2
  Gene Name: Rap guanine nucleotide exchange factor (GEF) 2
  ENSP ID: ENSP00000421624
  MOD_RES (1)..(1): Any amino acid
XKKMGGHLRLLNIACAAKAKRRLMTLTKPSREAPLPFILLGGSEKGFGIFVDSVDSGSKATEAGLKRGDQILEVNGQNFENIQLSKAMEILRNNTHLSITVKTNLFVFKELLTRLSEEKRNGAPHLPKIGDIKKASRYSIPDLAVDVEQVIGLEKVNKKSKANTVGGRNKLKKILDKTRISILPQKPYK

SEQ ID NO: 71505 - protein, 155 aa, Homo sapiens
  Payload ID: 14154
  Gene Symbol: RAPGEF2
  Gene Name: Rap guanine nucleotide exchange factor (GEF) 2
  ENSP ID: ENSP00000421740
MAFLVRCYANCLQPWSSKLPADFTKLHLTDSLHPQVTHVSSSHSGCSITSDSGSSSLSDIYQATESEAGDMDLSGLPETAVDSEDDDDEEDIERASDPLMSRDIVRDCLEKDPIDRTDDDIEQLLEFMHQLPAFANMTMSVRRELCAVMVFAVVE

SEQ ID NO: 71506 - protein, 182 aa, Homo sapiens
  Payload ID: 14154
  Gene Symbol: RAPGEF2
  Gene Name: Rap guanine nucleotide exchange factor (GEF) 2
  ENSP ID: ENSP00000422098
  MOD_RES (1)..(1): Any amino acid
XVDGLVNFEKLRMIAKEIRHVGRMASVNMDPALMFRTRSLSQGSTNATVLDVAQTGGHKKRVRRSSFLNAKKLYEDAQMARKVKQYLSNLELEMDEESLQTLSLQCEPATNTLPKNPGDKKPVKSETSPVAPRAGSQQKAQSLPQPQQQPPPAHKINQGLQVPAVSLYPSRKKVPVKDLPPF

SEQ ID NO: 71507 - protein, 154 aa, Homo sapiens
  Payload ID: 14154
  Gene Symbol: RAPGEF2
  Gene Name: Rap guanine nucleotide exchange factor (GEF) 2
  ENSP ID: ENSP00000422361
MLPADFTKLHLTDSLHPQVTHVSSSHSGCSITSDSGSSSLSDIYQATESEAGDMDLSGLPETAVDSEDDDDEEDIERASDPLMSRDIVRDCLEKDPIDRTDDDIEQLLEFMHQLPAFANMTMSVRRELCAVMVFAVVERAGTIVLNDGEELDSW

SEQ ID NO: 71508 - protein, 279 aa, Homo sapiens
  Payload ID: 14154
  Gene Symbol: RAPGEF2
  Gene Name: Rap guanine nucleotide exchange factor (GEF) 2
  ENSP ID: ENSP00000422707
DNSFRQAVMKNPPERTPQDLEIVYSYLHGMEALSNLREHQLRLMCETVRYERHEANEVLYYPDDIGTCWYILLSGSVFIKESMFLPRSSFGKRSAGSFRRGCECIVLEPSEMIVVDYMDENEEYFQRQASHRQSRRRFRKINQKGERQTIIDTVDPYPMGKPPLPRGYHTECTKSQLPADFTKLHLTDSLHPQVTHVSSSHSGCSITSDSGSSSLSDIYQATESEAGDMDLSGLPETAVDSEDDDDEEDIERASDPLMSRDIVRDCLEKDPIDRTDDDI

SEQ ID NO: 71509 - protein, 324 aa, Homo sapiens
  Payload ID: 14154
  Gene Symbol: RAPGEF2
  Gene Name: Rap guanine nucleotide exchange factor (GEF) 2
  ENSP ID: ENSP00000427334
  MOD_RES (1)..(1): Any amino acid
XSNASSQLSSPPTSPQSSPRKGGSGNQLRSFGSGQLDLTSSSSSLGSENSNKNNNAPRTYGIGYTLAPSGTVDNFSDSGHSEISSRSSIVSNSSFDSVPVSLHDERRQRHSVSIVETNLGMGRMERRTMIEPDQYSLGSYAPMSEGRGLYATATVISSPSTEELSQDQGDRASLDAADSGRGSWTSCSSGSHDNIQTIQHQRSWETLPFGHTHFDYSGDPAGLWASSSHMDQIMFSDHSTKYNRQNQSRESLEQAQSRASWASSTGYWGEDSEGDTGTIKRRGGKDVSIEAESSSLTSVTTEETKPVPMPAHIAVASSTTKGLI

SEQ ID NO: 71510 - protein, 923 aa, Homo sapiens
  Payload ID: 14155
  Gene Symbol: RAPGEF3
  Gene Name: Rap guanine nucleotide exchange factor (GEF) 3
  Uniprot ID: O95398
  ENSP ID: ENSP00000373864
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 71511 - protein, 598 aa, Homo sapiens
  Payload ID: 14155
  Gene Symbol: RAPGEF3
  Gene Name: Rap guanine nucleotide exchange factor (GEF) 3
  Uniprot ID: O95398
  ENSP ID: ENSP00000378764
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKVSAWPQFLSSAPPGLQAPPSPPDPEGLCGRGKLSSHRHTLGSLIGVHGALAACGALGQAVPGGAEA

SEQ ID NO: 71512 - protein, 881 aa, Homo sapiens
  Payload ID: 14155
  Gene Symbol: RAPGEF3
  Gene Name: Rap guanine nucleotide exchange factor (GEF) 3
  Uniprot ID: O95398
  ENSP ID: ENSP00000384521
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 71513 - protein, 923 aa, Homo sapiens; identical to SEQ ID NO: 71510
  Payload ID: 14155
  Gene Symbol: RAPGEF3
  Gene Name: Rap guanine nucleotide exchange factor (GEF) 3
  Uniprot ID: O95398
  ENSP ID: ENSP00000395708

SEQ ID NO: 71514 - protein, 222 aa, Homo sapiens
  Payload ID: 14155
  Gene Symbol: RAPGEF3
  Gene Name: Rap guanine nucleotide exchange factor (GEF) 3
  ENSP ID: ENSP00000446731
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFE

SEQ ID NO: 71515 - protein, 184 aa, Homo sapiens
  Payload ID: 14155
  Gene Symbol: RAPGEF3
  Gene Name: Rap guanine nucleotide exchange factor (GEF) 3
  ENSP ID: ENSP00000447691
  MOD_RES (1)..(1): Any amino acid
XAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLC

SEQ ID NO: 71516 - protein, 814 aa, Homo sapiens
  Payload ID: 14155
  Gene Symbol: RAPGEF3
  Gene Name: Rap guanine nucleotide exchange factor (GEF) 3
  ENSP ID: ENSP00000448480
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVRTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 71517 - protein, 881 aa, Homo sapiens; identical to SEQ ID NO: 71512
  Payload ID: 14155
  Gene Symbol: RAPGEF3
  Gene Name: Rap guanine nucleotide exchange factor (GEF) 3
  Uniprot ID: O95398
  ENSP ID: ENSP00000448619

SEQ ID NO: 71518 - protein, 141 aa, Homo sapiens
  Payload ID: 14155
  Gene Symbol: RAPGEF3
  Gene Name: Rap guanine nucleotide exchange factor (GEF) 3
  ENSP ID: ENSP00000448804
MVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYR

SEQ ID NO: 71519 - protein, 108 aa, Homo sapiens
  Payload ID: 14155
  Gene Symbol: RAPGEF3
  Gene Name: Rap guanine nucleotide exchange factor (GEF) 3
  ENSP ID: ENSP00000449818
FPGPEPEPVRTHEMEEELAEAVALLSQRGPDALLTVALRKPPGQRTDEELDLIFEELLHIKAVAHLSNSVKRELAAVLLFEPHSKAGTVSRGTRALRGTLSGRDLSTW

SEQ ID NO: 71520 - protein, 79 aa, Homo sapiens
  Payload ID: 14155
  Gene Symbol: RAPGEF3
  Gene Name: Rap guanine nucleotide exchange factor (GEF) 3
  ENSP ID: ENSP00000449905
MKVGWPGESCWQVGLAVEDSPALGAPRVGALPDVVPEGTLLNMVLRRMHRPRSCSYQLLLEHQRPSCIQGLRWPRSAHG

SEQ ID NO: 71521 - protein, 1011 aa, Homo sapiens
  Payload ID: 14156
  Gene Symbol: RAPGEF4
  Gene Name: Rap guanine nucleotide exchange factor (GEF) 4
  Uniprot ID: Q8WZA2
  ENSP ID: ENSP00000380271
MVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 71522 - protein, 187 aa, Homo sapiens
  Payload ID: 14156
  Gene Symbol: RAPGEF4
  Gene Name: Rap guanine nucleotide exchange factor (GEF) 4
  ENSP ID: ENSP00000380274
LMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMVCAVL

SEQ ID NO: 71523 - protein, 867 aa, Homo sapiens
  Payload ID: 14156
  Gene Symbol: RAPGEF4
  Gene Name: Rap guanine nucleotide exchange factor (GEF) 4
  Uniprot ID: Q8WZA2
  ENSP ID: ENSP00000380276
MLYKKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 71524 - protein, 943 aa, Homo sapiens
  Payload ID: 14156
  Gene Symbol: RAPGEF4
  Gene Name: Rap guanine nucleotide exchange factor (GEF) 4
  ENSP ID: ENSP00000387104
MVAAHAAHSSSSAEWIACLDKRPLERSSEDVDIIFTRLKEVKAFEKFHPNLLHQICLCGYYENLEKGITLFRQGDIGTNWYAVLAGSLDVKVSETSSHQDAVTICTLGIGTAFGESILDNTPRHATIVTRESSELLRIEQKDFKALWEKYRQYMAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWERMIANTARTVRYYRSQPFNPDAAQANKNHQDVRSYVRQLNVIDNQRTLSQMSHRLEPRRP

SEQ ID NO: 71525 - protein, 791 aa, Homo sapiens
  Payload ID: 14156
  Gene Symbol: RAPGEF4
  Gene Name: Rap guanine nucleotide exchange factor (GEF) 4
  ENSP ID: ENSP00000438011
MIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 71526 - protein, 840 aa, Homo sapiens
  Payload ID: 14156
  Gene Symbol: RAPGEF4
  Gene Name: Rap guanine nucleotide exchange factor (GEF) 4
  Uniprot ID: Q8WZA2
  ENSP ID: ENSP00000440135
MAGLLAPPYGVMETGSNNDRIPDKENVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 71527 - protein, 858 aa, Homo sapiens
  Payload ID: 14156
  Gene Symbol: RAPGEF4
  Gene Name: Rap guanine nucleotide exchange factor (GEF) 4
  Uniprot ID: Q8WZA2
  ENSP ID: ENSP00000440250
MAGLLAPPYGVMETGSNNDRIPDKENTPLIEPHVPLRPANTITKVPSEKILRAGKILRNAILSRAPHMIRDRKYHLKTYRQCCVGTELVDWMMQQTPCVHSRTQAVGMWQVLLEDGVLNHVDQEHHFQDKYLFYRFLDDEHEDAPLPTEEEKKECDEELQDTMLLLSQMGPDAHMRMILRKPPGQRTVDDLEIIYEELLHIKALSHLSTTVKRELAGVLIFESHAKGGTVLFNQGEEGTSWYIILKGSVNVVIYGKGVVCTLHEGDDFGKLALVNDAPRAASIVLREDNCHFLRVDKEDFNRILRDVEANTVRLKEHDQDVLVLEKVPAGNRASNQGNSQPQQKYTVMSGTPEKILEHFLETIRLEATLNEATDSVLNDFIMMHCVFMPNTQLCPALVAHYHAQPSQGTEQEKMDYALNNKRRVIRLVLQWAAMYGDLLQEDDVSMAFLEEFYVSVSDDARMIAALKEQLPELEKIVKQISEDAKAPQKKHKVLLQQFNTGDERAQKRQPIRGSDEVLFKVYCMDHTYTTIRVPVATSVKEVISAVADKLGSGEGLIIVKMSSGGEKVVLKPNDVSVFTTLTINGRLFACPREQFDSLTPLPEQEGPTVGTVGTFELMSSKDLAYQMTIYDWELFNCVHELELIYHTFGRHNFKKTTANLDLFLRRFNEIQFWVVTEICLCSQLSKRVQLLKKFIKIAAHCKEYKNLNSFFAIVMGLSNVAVSRLALTWEKLPSKFKKFYAEFESLMDPSRNHRAYRLTVAKLEPPLIPFMPLLIKDMTFTHEGNKTFIDNLVNFEKMRMIANTARTVRYYRSQPFNPDAAQANKNHQDVRSYVRQLNVIDNQRTLSQMSHRLEPRRP

SEQ ID NO: 71528 - protein, 730 aa, Homo sapiens
  Payload ID: 14157
  Gene Symbol: RAPGEF5
  Gene Name: Rap guanine nucleotide exchange factor (GEF) 5
  ENSP ID: ENSP00000343656
MAIGVWQLLLDMGIMLSVDQHLYFQDTYVFYQFSSDECSYLYCEFEREEEWQNGVKLLLQLVPLIPARGGICELSHQKIEDSEESSDEILVRLTSAVQRELAAVIALKARKSAIEQDEENNDKHVAVTEAESVPDSQAGVMCKLQERDEIGRIELVQKLAKENYQFLQTDKKEQEKSEHQDDEVTTVQVKEQDQSVLVLKKVQCCGPAPTAGSAESHWRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 71529 - protein, 580 aa, Homo sapiens
  Payload ID: 14157
  Gene Symbol: RAPGEF5
  Gene Name: Rap guanine nucleotide exchange factor (GEF) 5
  Uniprot ID: Q92565
  ENSP ID: ENSP00000384044
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 71530 - protein, 400 aa, Homo sapiens
  Payload ID: 14157
  Gene Symbol: RAPGEF5
  Gene Name: Rap guanine nucleotide exchange factor (GEF) 5
  ENSP ID: ENSP00000384870
MRMAVGSVKMQPPCESPALAAAAAVVAADGPLRRSPSAREPEREQPPASLRPRLRDLPALLRSGLTLRRKRSAAGGRTLSRRISNPYLEHTPSQIYGENSSCAGRALRNIIIVQAADLIKDRVNLKGFYRRSCVGSELVDWLLEHCPFVQCRSMAIGVWQLLLDMGIMLSVDQHLYFQDTYVFYQFSSDECSYLYCEFEREEEWQNGVKLLLQLVPLIPARGGICELSHQKIEDSEESSDEILVRLTSAVQRELAAVIALKARKSAIEQDEENNDKHVAVTEAESVPDSQAGVMCKLQERDEIGRIELVQKLAKENYQFLQTDKKEQEKSEHQDDEVTTVQVKEQDQSVLVLKKVQCCGPAPTAGSAESHWSVLADCRALSSQMDSVPSERTGMARSFSI

SEQ ID NO: 71531 - protein, 155 aa, Homo sapiens
  Payload ID: 14157
  Gene Symbol: RAPGEF5
  Gene Name: Rap guanine nucleotide exchange factor (GEF) 5
  ENSP ID: ENSP00000395729
MSWDCGFKYIFAFSPTLKAGVMCKLQERDEIGRIELVQKLAKENYQFLQTDKKEQEKSEHQDDEVTTVQVKEQDQSVLVLKKVQCCGPAPTAGSAESHWRYVVVSGTPEKILEHLLNDLHLEEVQDKETETLLDDFLLTYTVFMTTDDLCQALLR

SEQ ID NO: 71532 - protein, 124 aa, Homo sapiens
  Payload ID: 14157
  Gene Symbol: RAPGEF5
  Gene Name: Rap guanine nucleotide exchange factor (GEF) 5
  ENSP ID: ENSP00000403956
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETVIPTPGITCVTSAMCSQSQADQDFMA

SEQ ID NO: 71533 - protein, 142 aa, Homo sapiens
  Payload ID: 14157
  Gene Symbol: RAPGEF5
  Gene Name: Rap guanine nucleotide exchange factor (GEF) 5
  ENSP ID: ENSP00000415664
MTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSY

SEQ ID NO: 71534 - protein, 444 aa, Homo sapiens
  Payload ID: 14157
  Gene Symbol: RAPGEF5
  Gene Name: Rap guanine nucleotide exchange factor (GEF) 5
  Uniprot ID: Q92565
  ENSP ID: ENSP00000479340
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 71535 - protein, 1609 aa, Homo sapiens
  Payload ID: 14158
  Gene Symbol: RAPGEF6
  Gene Name: Rap guanine nucleotide exchange factor (GEF) 6
  Uniprot ID: Q8TEU7
  ENSP ID: ENSP00000296859
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRKKRWRSLGSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIVYCVTSPKKDDRYREPPPTPPGYLGISLADLKEGPHTHLKPPDYSVAVQRSKMMHNSLSRLPPASLSSNLVACVPSKIVTQPQRHNLQPFHPKLGDVTDADSEADENEQVSAV

SEQ ID NO: 71536 - protein, 1391 aa, Homo sapiens
  Payload ID: 14158
  Gene Symbol: RAPGEF6
  Gene Name: Rap guanine nucleotide exchange factor (GEF) 6
  Uniprot ID: Q8TEU7
  ENSP ID: ENSP00000311419
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKVGSIISDHSSKISGQSCPGIGGAYLQKKILQITRSTAKRTDSTEKATEENRDRTSCENTTRKRMTSPFRRLRERMLSRERLVNSQKEDTDHNQATESCEKVKDVGSNIKDEKGSAIFNSNSQGNSNTLNCFYTRFKSKRRKTL

SEQ ID NO: 71537 - protein, 1601 aa, Homo sapiens
  Payload ID: 14158
  Gene Symbol: RAPGEF6
  Gene Name: Rap guanine nucleotide exchange factor (GEF) 6
  Uniprot ID: Q8TEU7
  ENSP ID: ENSP00000421684
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIVYCVTSPKKDDRYREPPPTPPGYLGISLADLKEGPHTHLKPPDYSVAVQRSKMMHNSLSRLPPASLSSNLVACVPSKIVTQPQRHNLQPFHPKLGDVTDADSEADENEQVSAV

SEQ ID NO: 71538 - protein, 155 aa, Homo sapiens
  Payload ID: 14158
  Gene Symbol: RAPGEF6
  Gene Name: Rap guanine nucleotide exchange factor (GEF) 6
  ENSP ID: ENSP00000424574
MHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVE

SEQ ID NO: 71539 - protein, 827 aa, Homo sapiens
  Payload ID: 14158
  Gene Symbol: RAPGEF6
  Gene Name: Rap guanine nucleotide exchange factor (GEF) 6
  Uniprot ID: Q8TEU7
  ENSP ID: ENSP00000425389
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGR

SEQ ID NO: 71540 - protein, 1204 aa, Homo sapiens
  Payload ID: 14158
  Gene Symbol: RAPGEF6
  Gene Name: Rap guanine nucleotide exchange factor (GEF) 6
  ENSP ID: ENSP00000425772
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALM

SEQ ID NO: 71541 - protein, 155 aa, Homo sapiens
  Payload ID: 14158
  Gene Symbol: RAPGEF6
  Gene Name: Rap guanine nucleotide exchange factor (GEF) 6
  ENSP ID: ENSP00000425891
MAFLVRCYANCLQPWASKLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVE

SEQ ID NO: 71542 - protein, 1509 aa, Homo sapiens
  Payload ID: 14158
  Gene Symbol: RAPGEF6
  Gene Name: Rap guanine nucleotide exchange factor (GEF) 6
  Uniprot ID: Q8TEU7
  ENSP ID: ENSP00000426081
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSAVGFYYIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRKKRWRSLGSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIENEQVSAV

SEQ ID NO: 71543 - protein, 1114 aa, Homo sapiens
  Payload ID: 14158
  Gene Symbol: RAPGEF6
  Gene Name: Rap guanine nucleotide exchange factor (GEF) 6
  ENSP ID: ENSP00000426910
MSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRKKRWRSLGSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKVGSIISDHSSKISGQSCPGIGGAYLQKKILQITRSTAKRTDSTEKATEENRDRTSCENTTRKRMTSPFRRLRERMLSRERLVNSQKEDTDHNQATESCEKVKDVGSNIKDEKGSAIFNSNSQGNSNTLNCFYTRFKSKRRKTL

SEQ ID NO: 71544 - protein, 149 aa, Homo sapiens
  Payload ID: 14158
  Gene Symbol: RAPGEF6
  Gene Name: Rap guanine nucleotide exchange factor (GEF) 6
  ENSP ID: ENSP00000427102
MAFLVRCYANCLQPWASKLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVM

SEQ ID NO: 71545 - protein, 1504 aa, Homo sapiens
  Payload ID: 14158
  Gene Symbol: RAPGEF6
  Gene Name: Rap guanine nucleotide exchange factor (GEF) 6
  Uniprot ID: Q8TEU7
  ENSP ID: ENSP00000487439
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRKKRWRSLGSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKQRVLESTPAESSEGLDPKDATDPVYKTVTSSTEKGLIENEQVSAV

SEQ ID NO: 71546 - protein, 456 aa, Homo sapiens
  Payload ID: 14159
  Gene Symbol: RAPGEFL1
  Gene Name: Rap guanine nucleotide exchange factor (GEF)-like 1
  Uniprot ID: Q9UHV5
  ENSP ID: ENSP00000264644
MEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 71547 - protein, 511 aa, Homo sapiens
  Payload ID: 14159
  Gene Symbol: RAPGEFL1
  Gene Name: Rap guanine nucleotide exchange factor (GEF)-like 1
  Uniprot ID: Q9UHV5
  ENSP ID: ENSP00000394530
MLIHPRGLPSSSHRRKINSTYFYILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 71548 - protein, 505 aa, Homo sapiens
  Payload ID: 14159
  Gene Symbol: RAPGEFL1
  Gene Name: Rap guanine nucleotide exchange factor (GEF)-like 1
  ENSP ID: ENSP00000438631
MMLRPGYPLSQESFPIDILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 71549 - protein, 20 aa, Homo sapiens
  Payload ID: 14159
  Gene Symbol: RAPGEFL1
  Gene Name: Rap guanine nucleotide exchange factor (GEF)-like 1
  ENSP ID: ENSP00000440006
MEGPEGLGRKQACLAMLLHF

SEQ ID NO: 71550 - protein, 149 aa, Homo sapiens
  Payload ID: 14159
  Gene Symbol: RAPGEFL1
  Gene Name: Rap guanine nucleotide exchange factor (GEF)-like 1
  ENSP ID: ENSP00000440226
MEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEP

SEQ ID NO: 71551 - protein, 101 aa, Homo sapiens
  Payload ID: 14159
  Gene Symbol: RAPGEFL1
  Gene Name: Rap guanine nucleotide exchange factor (GEF)-like 1
  ENSP ID: ENSP00000441059
MEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTR

SEQ ID NO: 71552 - protein, 62 aa, Homo sapiens
  Payload ID: 14159
  Gene Symbol: RAPGEFL1
  Gene Name: Rap guanine nucleotide exchange factor (GEF)-like 1
  ENSP ID: ENSP00000444646
MAIKDILLDDIVLTHSLFLPTEKFLQELHQYFVRAGGMEGPEGLGRKQACLAMLLHFLDTYQ

SEQ ID NO: 71553 - protein, 662 aa, Homo sapiens
  Payload ID: 14159
  Gene Symbol: RAPGEFL1
  Gene Name: Rap guanine nucleotide exchange factor (GEF)-like 1
  ENSP ID: ENSP00000479735
MKPLEKFLKKQTSQLAGRTVAGGPGGGLGSCGGPGGGGGPGGGGGPAGGQRSLQRRQSVSRLLLPAFLREPPAEPGLEPPPEEEGGEPAGVAEEPGSGGPCWLQLEEVPGPGPLGGGGPLRSPSSYSSDELSPGEPLTSPPWAPLGAPERPEHLLNRVLERLAGGATRDSAASDILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGRRETANLELLLQRCSEVTHWVATEVLLCEAPGKRAQLLKKFIKIAALCKQNQDLLSFYAVVMGLDNAAVSRLRLTWEKLPGKFKNLFRKFENLTDPCRNHKSYREVISKMKPPVIPFVPLILKDLTFLHEGSKTLVDGLVNIEKLHSVAEKVRTIRKYRSRPLCLDMEASPNHLQTKAYVRQFQVIDNQNLLFELSYKLEANSQ

SEQ ID NO: 71554 - protein, 459 aa, Homo sapiens
  Payload ID: 14159
  Gene Symbol: RAPGEFL1
  Gene Name: Rap guanine nucleotide exchange factor (GEF)-like 1
  ENSP ID: ENSP00000484772
MKPLEKFLKKQTSQLAGRTVAGGPGGGLGSCGGPGGGGGPGGGGGPAGGQRSLQRRQSVSRLLLPAFLREPPAEPGLEPPPEEEGGEPAGVAEEPGSGGPCWLQLEEVPGPGPLGGGGPLRSPSSYSSDELSPGEPLTSPPWAPLGAPERPEHLLNRVLERLAGGATRDSAASDILLDDIVLTHSLFLPTEKFLQELHQYFVRAGGMEGPEGLGRKQACLAMLLHFLDTYQGLLQEEEGAGHIIKDLYLLIMKDESLYQGLREDTLRLHQLVETVELKIPEENQPPSKQVKPLFRHFRRIDSCLQTRVAFRGSDEIFCRVYMPDHSYVTIRSRLSASVQDILGSVTEKLQYSEEPAGREDSLILVAVSSSGEKVLLQPTEDCVFTALGINSHLFACTRDSYEALVPLPEEIQVSPGDTEIHRVEPEDVANHLTAFHWELFRCVHELEFVDYVFHGERGR

SEQ ID NO: 71555 - protein, 692 aa, Homo sapiens
  Payload ID: 14160
  Gene Symbol: RAP1GAP
  Gene Name: RAP1 GTPase activating protein
  ENSP ID: ENSP00000290101
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLSLIVPGKSPTRKKSGPFGSRRSSAIGIENIQEVQEKRESPPAGQKTPDSGHVSQEPKSENSSTQSSPEMPTTKNRAETAAQRAEALKLPLLVQCQQLRQRGGGDGGCGRRGHRPGERVILRNTPQAGLLHL

SEQ ID NO: 71556 - protein, 96 aa, Homo sapiens
  Payload ID: 14160
  Gene Symbol: RAP1GAP
  Gene Name: RAP1 GTPase activating protein
  ENSP ID: ENSP00000315420
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLG

SEQ ID NO: 71557 - protein, 694 aa, Homo sapiens
  Payload ID: 14160
  Gene Symbol: RAP1GAP
  Gene Name: RAP1 GTPase activating protein
  ENSP ID: ENSP00000363893
MAQLRPAVPPGRPRRGSLPAGASWQNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 71558 - protein, 748 aa, Homo sapiens
  Payload ID: 14160
  Gene Symbol: RAP1GAP
  Gene Name: RAP1 GTPase activating protein
  ENSP ID: ENSP00000363895
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEEVVVRGAAGSGGCLHALFSARSQDGGHIGDVAPLPPGQAPGRAGWSGGSSDGTQHLLWGLSLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 71559 - protein, 663 aa, Homo sapiens
  Payload ID: 14160
  Gene Symbol: RAP1GAP
  Gene Name: RAP1 GTPase activating protein
  Uniprot ID: P47736
  ENSP ID: ENSP00000363897
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 71560 - protein, 35 aa, Homo sapiens
  Payload ID: 14160
  Gene Symbol: RAP1GAP
  Gene Name: RAP1 GTPase activating protein
  ENSP ID: ENSP00000392717
MIEKMQGSRMDEQRCSFPPPLKTEEDYIPYPSVHE

SEQ ID NO: 71561 - protein, 602 aa, Homo sapiens
  Payload ID: 14160
  Gene Symbol: RAP1GAP
  Gene Name: RAP1 GTPase activating protein
  ENSP ID: ENSP00000431364
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLHVAGGQCQHH

SEQ ID NO: 71562 - protein, 727 aa, Homo sapiens
  Payload ID: 14160
  Gene Symbol: RAP1GAP
  Gene Name: RAP1 GTPase activating protein
  Uniprot ID: P47736
  ENSP ID: ENSP00000434033
MSGRKRSFTFGAYGGVDKSFTSRRSVWRSDGQNQHFPQALDLSRVNLVPSYTPSLYPKNTDLFEMIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 71563 - protein, 681 aa, Homo sapiens
  Payload ID: 14160
  Gene Symbol: RAP1GAP
  Gene Name: RAP1 GTPase activating protein
  Uniprot ID: P47736
  ENSP ID: ENSP00000441661
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDAALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLLIPGKSASRFGRRGSAIGIGTVEESLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPDAGKLGDPACPEIKIQLEASEQHMPQLGC

SEQ ID NO: 71564 - protein, 730 aa, Homo sapiens
  Payload ID: 14161
  Gene Symbol: RAP1GAP2
  Gene Name: RAP1 GTPase activating protein 2
  Uniprot ID: Q684P5
  ENSP ID: ENSP00000254695
MFGRKRSVSFGGFGWIDKTMLASLKVKKQELANSSDATLPDRPLSPPLTAPPTMKSSEFFEMLEKMQGIKLEEQKPGPQKNKDDYIPYPSIDEVVEKGGPYPQVILPQFGGYWIEDPENVGTPTSLGSSICEEEEEDNLSPNTFGYKLECKGEARAYRRHFLGKDHLNFYCTGSSLGNLILSVKCEEAEGIEYLRVILRSKLKTVHERIPLAGLSKLPSVPQIAKAFCDDAVGLRFNPVLYPKASQMIVSYDEHEVNNTFKFGVIYQKARQTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKGPEFREFLLTKLTNAENACCKSDKFAKLEDRTRAALLDNLHDELHAHTQAMLGLGPEEDKFENGGHGGFLESFKRAIRVRSHSMETMVGGQKKSHSGGIPGSLSGGISHNSMEVTKTTFSPPVVAATVKNQSRSPIKRRSGLFPRLHTGSEGQGDSRARCDSTSSTPKTPDGGHSSQEIKSETSSNPSSPEICPNKEKPFMKLKENGRAISRSSSSTSSVSSTAGEGEAMEEGDSGGSQPSTTSPFKQEVFVYSPSPSSESPSLGAAATPIIMSRSPTDAKSRNSPRSNLKFRFDKLSHASSGAGH

SEQ ID NO: 71565 - protein, 715 aa, Homo sapiens
  Payload ID: 14161
  Gene Symbol: RAP1GAP2
  Gene Name: RAP1 GTPase activating protein 2
  Uniprot ID: Q684P5
  ENSP ID: ENSP00000389824
MFGRKRSVSFGGFGWIDKTMLASLKVKKQELANSSDATLPDRPLSPPLTAPPTMKSSEFFEMLEKMQDDYIPYPSIDEVVEKGGPYPQVILPQFGGYWIEDPENVGTPTSLGSSICEEEEEDNLSPNTFGYKLECKGEARAYRRHFLGKDHLNFYCTGSSLGNLILSVKCEEAEGIEYLRVILRSKLKTVHERIPLAGLSKLPSVPQIAKAFCDDAVGLRFNPVLYPKASQMIVSYDEHEVNNTFKFGVIYQKARQTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKGPEFREFLLTKLTNAENACCKSDKFAKLEDRTRAALLDNLHDELHAHTQAMLGLGPEEDKFENGGHGGFLESFKRAIRVRSHSMETMVGGQKKSHSGGIPGSLSGGISHNSMEVTKTTFSPPVVAATVKNQSRSPIKRRSGLFPRLHTGSEGQGDSRARCDSTSSTPKTPDGGHSSQEIKSETSSNPSSPEICPNKEKPFMKLKENGRAISRSSSSTSSVSSTAGEGEAMEEGDSGGSQPSTTSPFKQEVFVYSPSPSSESPSLGAAATPIIMSRSPTDAKSRNSPRSNLKFRFDKLSHASSGAGH

SEQ ID NO: 71566 - protein, 711 aa, Homo sapiens
  Payload ID: 14161
  Gene Symbol: RAP1GAP2
  Gene Name: RAP1 GTPase activating protein 2
  Uniprot ID: Q684P5
  ENSP ID: ENSP00000439688
MLASLKVKKQELANSSDATLPDRPLSPPLTAPPTMKSSEFFEMLEKMQGIKLEEQKPGPQKNKDDYIPYPSIDEVVEKGGPYPQVILPQFGGYWIEDPENVGTPTSLGSSICEEEEEDNLSPNTFGYKLECKGEARAYRRHFLGKDHLNFYCTGSSLGNLILSVKCEEAEGIEYLRVILRSKLKTVHERIPLAGLSKLPSVPQIAKAFCDDAVGLRFNPVLYPKASQMIVSYDEHEVNNTFKFGVIYQKARQTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKGPEFREFLLTKLTNAENACCKSDKFAKLEDRTRAALLDNLHDELHAHTQAMLGLGPEEDKFENGGHGGFLESFKRAIRVRSHSMETMVGGQKKSHSGGIPGSLSGGISHNSMEVTKTTFSPPVVAATVKNQSRSPIKRRSGLFPRLHTGSEGQGDSRARCDSTSSTPKTPDGGHSSQEIKSETSSNPSSPEICPNKEKPFMKLKENGRAISRSSSSTSSVSSTAGEGEAMEEGDSGGSQPSTTSPFKQEVFVYSPSPSSESPSLGAAATPIIMSRSPTDAKSRNSPRSNLKFRFDKLSHASSGAGH

SEQ ID NO: 71567 - protein, 730 aa, Homo sapiens; identical to SEQ ID NO: 71564
  Payload ID: 14161
  Gene Symbol: RAP1GAP2
  Gene Name: RAP1 GTPase activating protein 2
  Uniprot ID: Q684P5
  ENSP ID: ENSP00000444890

SEQ ID NO: 71568 - protein, 516 aa, Homo sapiens
  Payload ID: 14162
  Gene Symbol: RAP1GDS1
  Gene Name: RAP1, GTP-GDP dissociation stimulator 1
  Uniprot ID: P52306
  ENSP ID: ENSP00000264572
MADNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSQSSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 71569 - protein, 608 aa, Homo sapiens
  Payload ID: 14162
  Gene Symbol: RAP1GDS1
  Gene Name: RAP1, GTP-GDP dissociation stimulator 1
  Uniprot ID: P52306
  ENSP ID: ENSP00000340454
MADNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 71570 - protein, 559 aa, Homo sapiens
  Payload ID: 14162
  Gene Symbol: RAP1GDS1
  Gene Name: RAP1, GTP-GDP dissociation stimulator 1
  Uniprot ID: P52306
  ENSP ID: ENSP00000369503
MADNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 71571 - protein, 607 aa, Homo sapiens
  Payload ID: 14162
  Gene Symbol: RAP1GDS1
  Gene Name: RAP1, GTP-GDP dissociation stimulator 1
  Uniprot ID: P52306
  ENSP ID: ENSP00000386153
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 71572 - protein, 558 aa, Homo sapiens
  Payload ID: 14162
  Gene Symbol: RAP1GDS1
  Gene Name: RAP1, GTP-GDP dissociation stimulator 1
  Uniprot ID: P52306
  ENSP ID: ENSP00000386223
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 71573 - protein, 607 aa, Homo sapiens
  Payload ID: 14162
  Gene Symbol: RAP1GDS1
  Gene Name: RAP1, GTP-GDP dissociation stimulator 1
  Uniprot ID: P52306
  ENSP ID: ENSP00000407157
MADNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 71574 - protein, 253 aa, Homo sapiens
  Payload ID: 14162
  Gene Symbol: RAP1GDS1
  Gene Name: RAP1, GTP-GDP dissociation stimulator 1
  ENSP ID: ENSP00000421482
  MOD_RES (1)..(1): Any amino acid
XANEKLLTVFCGMLMNYSNENDSLQAQLINMGVIPTLVKLLGIHCQNAALTEMCLVAFGNLAELDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKN

SEQ ID NO: 71575 - protein, 158 aa, Homo sapiens
  Payload ID: 14162
  Gene Symbol: RAP1GDS1
  Gene Name: RAP1, GTP-GDP dissociation stimulator 1
  ENSP ID: ENSP00000421599
MADNLSDTLKKLKITAVDKTEDSLEGCLDCLLQALAQNNTETSEKIQASGILQLFASLLTPQSSCKAKVANIIAEVAKNDEGRSAVDQAGGAQIVIDHLRSLCSITDPANEKLLTVFCGMLMNYSNENDSLQAQLINMGVIPTLVKLLGIHCQNAALT

SEQ ID NO: 71576 - protein, 39 aa, Homo sapiens
  Payload ID: 14162
  Gene Symbol: RAP1GDS1
  Gene Name: RAP1, GTP-GDP dissociation stimulator 1
  ENSP ID: ENSP00000422348
MADNLSDTLKKLKITAVDKTEDSLEGCLDCLLQALAQNR

SEQ ID NO: 71577 - protein, 38 aa, Homo sapiens
  Payload ID: 14162
  Gene Symbol: RAP1GDS1
  Gene Name: RAP1, GTP-GDP dissociation stimulator 1
  ENSP ID: ENSP00000422426
MDNLSDTLKKLKITAVDKTEDSLEGCLDCLLQALAQNR

SEQ ID NO: 71578 - protein, 118 aa, Homo sapiens
  Payload ID: 14162
  Gene Symbol: RAP1GDS1
  Gene Name: RAP1, GTP-GDP dissociation stimulator 1
  ENSP ID: ENSP00000424250
MDNLSDTLKKLKITAVDKTEDSLEGCLDCLLQALAQNNTETSEKIQASGILQLFASLLTPQSSCKAKVANIIAEVAKNGEVYLKNFSAGNVFSFTSYLVYANSMCGCWIDFTTGAAAK

SEQ ID NO: 71579 - protein, 158 aa, Homo sapiens
  Payload ID: 14162
  Gene Symbol: RAP1GDS1
  Gene Name: RAP1, GTP-GDP dissociation stimulator 1
  ENSP ID: ENSP00000424324
MDNLSDTLKKLKITAVDKTEDSLEGCLDCLLQALAQNNTETSEKIQASGILQLFASLLTPQSSCKAKVANIIAEVAKNDSLQAQLINMGVIPTLVKLLGIHCQNAALTEMCLVAFGNLAELESSKEQFASTNIAEELVKLFKKQIEHDKREMIFEVLA

SEQ ID NO: 71580 - protein, 122 aa, Homo sapiens
  Payload ID: 14162
  Gene Symbol: RAP1GDS1
  Gene Name: RAP1, GTP-GDP dissociation stimulator 1
  ENSP ID: ENSP00000425992
MDNLSDTLKKLKITAVDKTEDSLEGCLDCLLQALAQNKFMRIPCVDAGLISPLVQLLNSKDQEVLLQTGRALGNICYDSHSLQAQLINMGVIPTLVKLLGIHCQNAALTEMCLVAFGNLAEL

SEQ ID NO: 71581 - protein, 147 aa, Homo sapiens
  Payload ID: 14162
  Gene Symbol: RAP1GDS1
  Gene Name: RAP1, GTP-GDP dissociation stimulator 1
  ENSP ID: ENSP00000426096
MDNLSDTLKKLKITAVDKTEDSLEGCLDCLLQALAQNKFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKL

SEQ ID NO: 71582 - protein, 101 aa, Homo sapiens
  Payload ID: 14162
  Gene Symbol: RAP1GDS1
  Gene Name: RAP1, GTP-GDP dissociation stimulator 1
  ENSP ID: ENSP00000475933
  MOD_RES (1)..(1): Any amino acid
XNDSLQAQLINMGVIPTLVKLLGIHCQNAALTEMCLVAFGNLAELGCTGSVVPASASGEGLRKLTIMAEGEEGAGVSHGETGSERERQRGSHRLLTRSHMN

SEQ ID NO: 71583 - protein, 184 aa, Homo sapiens
  Payload ID: 14163
  Gene Symbol: RAP1A
  Gene Name: RAP1A, member of RAS oncogene family
  Uniprot ID: P62834
  ENSP ID: ENSP00000348786
MREYKLVVLGSGGVGKSALTVQFVQGIFVEKYDPTIEDSYRKQVEVDCQQCMLEILDTAGTEQFTAMRDLYMKNGQGFALVYSITAQSTFNDLQDLREQILRVKDTEDVPMILVGNKCDLEDERVVGKEQGQNLARQWCNCAFLESSAKSKINVNEIFYDLVRQINRKTPVEKKKPKKKSCLLL

SEQ ID NO: 71584 - protein, 184 aa, Homo sapiens; identical to SEQ ID NO: 71583
  Payload ID: 14163
  Gene Symbol: RAP1A
  Gene Name: RAP1A, member of RAS oncogene family
  Uniprot ID: P62834
  ENSP ID: ENSP00000358723

SEQ ID NO: 71585 - protein, 129 aa, Homo sapiens
  Payload ID: 14163
  Gene Symbol: RAP1A
  Gene Name: RAP1A, member of RAS oncogene family
  ENSP ID: ENSP00000396741
MREYKLVVLGSGGVGKSALTVQFVQGIFVEKYDPTIEDSYRKQVEVDCQQCMLEILDTAGTEQFTAMRDLYMKNGQGFALVYSITAQSTFNDLQDLREQILRVKDTEDVPMILVGNKCDLEDERVVGKE

SEQ ID NO: 71586 - protein, 184 aa, Homo sapiens
  Payload ID: 14164
  Gene Symbol: RAP1B
  Gene Name: RAP1B, member of RAS oncogene family
  Uniprot ID: P61224
  ENSP ID: ENSP00000250559
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 71587 - protein, 118 aa, Homo sapiens
  Payload ID: 14164
  Gene Symbol: RAP1B
  Gene Name: RAP1B, member of RAS oncogene family
  ENSP ID: ENSP00000368270
MRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 71588 - protein, 184 aa, Homo sapiens; identical to SEQ ID NO: 71586
  Payload ID: 14164
  Gene Symbol: RAP1B
  Gene Name: RAP1B, member of RAS oncogene family
  Uniprot ID: P61224
  ENSP ID: ENSP00000377085

SEQ ID NO: 71589 - protein, 32 aa, Homo sapiens
  Payload ID: 14164
  Gene Symbol: RAP1B
  Gene Name: RAP1B, member of RAS oncogene family
  ENSP ID: ENSP00000390972
MREYKLVVLGSGGVGKSALTVQFVQGIFVEKY

SEQ ID NO: 71590 - protein, 142 aa, Homo sapiens
  Payload ID: 14164
  Gene Symbol: RAP1B
  Gene Name: RAP1B, member of RAS oncogene family
  Uniprot ID: P61224
  ENSP ID: ENSP00000399986
MREYKLVVLGSGGVGKSALEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 71591 - protein, 157 aa, Homo sapiens
  Payload ID: 14164
  Gene Symbol: RAP1B
  Gene Name: RAP1B, member of RAS oncogene family
  ENSP ID: ENSP00000401095
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEV

SEQ ID NO: 71592 - protein, 122 aa, Homo sapiens
  Payload ID: 14164
  Gene Symbol: RAP1B
  Gene Name: RAP1B, member of RAS oncogene family
  ENSP ID: ENSP00000437415
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLED

SEQ ID NO: 71593 - protein, 98 aa, Homo sapiens
  Payload ID: 14164
  Gene Symbol: RAP1B
  Gene Name: RAP1B, member of RAS oncogene family
  ENSP ID: ENSP00000438088
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLRE

SEQ ID NO: 71594 - protein, 84 aa, Homo sapiens
  Payload ID: 14164
  Gene Symbol: RAP1B
  Gene Name: RAP1B, member of RAS oncogene family
  ENSP ID: ENSP00000438311
MREYKLVVLGSGGVGKSALTVQFVQGIFVEKYDPTIEDSYRKQVEVDAQQCMLEILDTAGTEQFTAMRDLYMKNGQGFALVYSI

SEQ ID NO: 71595 - protein, 184 aa, Homo sapiens; identical to SEQ ID NO: 71586
  Payload ID: 14164
  Gene Symbol: RAP1B
  Gene Name: RAP1B, member of RAS oncogene family
  Uniprot ID: P61224
  ENSP ID: ENSP00000439966

SEQ ID NO: 71596 - protein, 137 aa, Homo sapiens
  Payload ID: 14164
  Gene Symbol: RAP1B
  Gene Name: RAP1B, member of RAS oncogene family
  Uniprot ID: P61224
  ENSP ID: ENSP00000440014
MREYKLVVLGSGGVGKSALTVQFVQGIFVEKYDPTIEDSYRKQVEVDAQQCMLEILDTAGTVPMILVGNKCDLEDERVVGKEQGQNLARQWNNCAFLESSAKSKINVNEIFYDLVRQINRKTPVPGKARKKSSCQLL

SEQ ID NO: 71597 - protein, 139 aa, Homo sapiens
  Payload ID: 14164
  Gene Symbol: RAP1B
  Gene Name: RAP1B, member of RAS oncogene family
  ENSP ID: ENSP00000440466
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWN

SEQ ID NO: 71598 - protein, 53 aa, Homo sapiens
  Payload ID: 14164
  Gene Symbol: RAP1B
  Gene Name: RAP1B, member of RAS oncogene family
  ENSP ID: ENSP00000440635
MREYKLVVLGSGGVGKSALTVQFVQGIFVEKYDPTIEDSYRKQVEVDAQQCML

SEQ ID NO: 71599 - protein, 136 aa, Homo sapiens
  Payload ID: 14164
  Gene Symbol: RAP1B
  Gene Name: RAP1B, member of RAS oncogene family
  ENSP ID: ENSP00000440708
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDIFYDLVRQINRKTPVPGKARKKSSCQLL

SEQ ID NO: 71600 - protein, 184 aa, Homo sapiens; identical to SEQ ID NO: 71586
  Payload ID: 14164
  Gene Symbol: RAP1B
  Gene Name: RAP1B, member of RAS oncogene family
  Uniprot ID: P61224
  ENSP ID: ENSP00000441275

SEQ ID NO: 71601 - protein, 87 aa, Homo sapiens
  Payload ID: 14164
  Gene Symbol: RAP1B
  Gene Name: RAP1B, member of RAS oncogene family
  ENSP ID: ENSP00000441952
MREYKLVVLGSGGVGKSALTVQFVQGIFVEKYDPTIEDSYRKQVEVDAQQCMLEILDTAGTEQFTAMRDLYMKNGQGFALVYSITAQ

SEQ ID NO: 71602 - protein, 103 aa, Homo sapiens
  Payload ID: 14164
  Gene Symbol: RAP1B
  Gene Name: RAP1B, member of RAS oncogene family
  ENSP ID: ENSP00000443775
MRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKT

SEQ ID NO: 71603 - protein, 179 aa, Homo sapiens
  Payload ID: 14164
  Gene Symbol: RAP1B
  Gene Name: RAP1B, member of RAS oncogene family
  ENSP ID: ENSP00000443851
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEVWSNILKMGLHLKYNIEDEWKMS

SEQ ID NO: 71604 - protein, 127 aa, Homo sapiens
  Payload ID: 14164
  Gene Symbol: RAP1B
  Gene Name: RAP1B, member of RAS oncogene family
  ENSP ID: ENSP00000444060
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVG

SEQ ID NO: 71605 - protein, 121 aa, Homo sapiens
  Payload ID: 14164
  Gene Symbol: RAP1B
  Gene Name: RAP1B, member of RAS oncogene family
  ENSP ID: ENSP00000444467
MLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVP

SEQ ID NO: 71606 - protein, 101 aa, Homo sapiens
  Payload ID: 14164
  Gene Symbol: RAP1B
  Gene Name: RAP1B, member of RAS oncogene family
  ENSP ID: ENSP00000444786
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQIL

SEQ ID NO: 71607 - protein, 142 aa, Homo sapiens; identical to SEQ ID NO: 71590
  Payload ID: 14164
  Gene Symbol: RAP1B
  Gene Name: RAP1B, member of RAS oncogene family
  Uniprot ID: P61224
  ENSP ID: ENSP00000444830

SEQ ID NO: 71608 - protein, 48 aa, Homo sapiens
  Payload ID: 14164
  Gene Symbol: RAP1B
  Gene Name: RAP1B, member of RAS oncogene family
  ENSP ID: ENSP00000444924
MREYKLVVLGSGGVGKSALTVQFVQGIFVEKYDPTIEDSYRKQVEVDA

SEQ ID NO: 71609 - protein, 118 aa, Homo sapiens; identical to SEQ ID NO: 71587
  Payload ID: 14164
  Gene Symbol: RAP1B
  Gene Name: RAP1B, member of RAS oncogene family
  ENSP ID: ENSP00000445090

SEQ ID NO: 71610 - protein, 93 aa, Homo sapiens
  Payload ID: 14164
  Gene Symbol: RAP1B
  Gene Name: RAP1B, member of RAS oncogene family
  ENSP ID: ENSP00000445138
MREYKLVVLGSGGVGKSALTVQFVQGIFVEKYDPTIEDSYRKQVEVDAQQCMLEILDTAGTEQFTAMRDLYMKNGQGFALVYSITAQSTFNDL

SEQ ID NO: 71611 - protein, 11 aa, Homo sapiens
  Payload ID: 14164
  Gene Symbol: RAP1B
  Gene Name: RAP1B, member of RAS oncogene family
  ENSP ID: ENSP00000445977
MREYKLVVLGS

SEQ ID NO: 71612 - protein, 11 aa, Homo sapiens
  Payload ID: 14164
  Gene Symbol: RAP1B
  Gene Name: RAP1B, member of RAS oncogene family
  ENSP ID: ENSP00000446027
MREYKLVVLGS

SEQ ID NO: 71613 - protein, 165 aa, Homo sapiens
  Payload ID: 14164
  Gene Symbol: RAP1B
  Gene Name: RAP1B, member of RAS oncogene family
  Uniprot ID: P61224
  ENSP ID: ENSP00000446318
MREYKLVVLGSGGVGKSALTVQFVQGIFVEKYDPTIEDSYRKEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 71614 - protein, 183 aa, Homo sapiens
  Payload ID: 14165
  Gene Symbol: RAP2A
  Gene Name: RAP2A, member of RAS oncogene family
  Uniprot ID: P10114
  ENSP ID: ENSP00000245304
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIIRVKRYEKVPVILVGNKVDLESEREVSSSEGRALAEEWGCPFMETSAKSKTMVDELFAEIVRQMNYAAQPDKDDPCCSACNIQ

SEQ ID NO: 71615 - protein, 108 aa, Homo sapiens
  Payload ID: 14165
  Gene Symbol: RAP2A
  Gene Name: RAP2A, member of RAS oncogene family
  ENSP ID: ENSP00000436462
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIIRVKRPML

SEQ ID NO: 71616 - protein, 183 aa, Homo sapiens
  Payload ID: 14166
  Gene Symbol: RAP2B
  Gene Name: RAP2B, member of RAS oncogene family
  Uniprot ID: P61225
  ENSP ID: ENSP00000319096
MREYKVVVLGSGGVGKSALTVQFVTGSFIEKYDPTIEDFYRKEIEVDSSPSVLEILDTAGTEQFASMRDLYIKNGQGFILVYSLVNQQSFQDIKPMRDQIIRVKRYERVPMILVGNKVDLEGEREVSYGEGKALAEEWSCPFMETSAKNKASVDELFAEIVRQMNYAAQPNGDEGCCSACVIL

SEQ ID NO: 71617 - protein, 183 aa, Homo sapiens
  Payload ID: 14167
  Gene Symbol: RAP2C
  Gene Name: RAP2C, member of RAS oncogene family
  Uniprot ID: Q9Y3L5
  ENSP ID: ENSP00000340274
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIVRVKRYEKVPLILVGNKVDLEPEREVMSSEGRALAQEWGCPFMETSAKSKSMVDELFAEIVRQMNYSSLPEKQDQCCTTCVVQ

SEQ ID NO: 71618 - protein, 183 aa, Homo sapiens; identical to SEQ ID NO: 71617
  Payload ID: 14167
  Gene Symbol: RAP2C
  Gene Name: RAP2C, member of RAS oncogene family
  Uniprot ID: Q9Y3L5
  ENSP ID: ENSP00000359911

SEQ ID NO: 71619 - protein, 117 aa, Homo sapiens
  Payload ID: 14167
  Gene Symbol: RAP2C
  Gene Name: RAP2C, member of RAS oncogene family
  ENSP ID: ENSP00000484870
MRDLYIKNGQGFILVYSLVNQQSFQDIKPMRDQIVRVKRYEKVPLILVGNKVDLEPEREVMSSEGRALAQEWGCPFMETSAKSKSMVDELFAEIVRQMNYSSLPEKQDQCCTTCVVQ

SEQ ID NO: 71620 - protein, 556 aa, Homo sapiens
  Payload ID: 14168
  Gene Symbol: RORA
  Gene Name: RAR-related orphan receptor A
  Uniprot ID: P35398
  ENSP ID: ENSP00000261523
MNEGAPGDSDLETEARVPWSIMGHCLRTGQARMSATPTPAGEGARRDELFGILQILHQCILSSGDAFVLTGVCCSWRQNGKPPYSQKEDKEVQTGYMNAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 71621 - protein, 548 aa, Homo sapiens
  Payload ID: 14168
  Gene Symbol: RORA
  Gene Name: RAR-related orphan receptor A
  ENSP ID: ENSP00000309753
MNEGAPGDSDLETEARVPWSIMGHCLRTGQARMSATPTPAGEGARSSSTCSSLSRLFWSQLEHINWDGATAKNFINLREFFSFLLPALRKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 71622 - protein, 523 aa, Homo sapiens
  Payload ID: 14168
  Gene Symbol: RORA
  Gene Name: RAR-related orphan receptor A
  Uniprot ID: P35398
  ENSP ID: ENSP00000335087
MESAPAAPDPAASEPGSSGADAAAGSRETPLNQESARKSEPPAPVRRQSYSSTSRGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 71623 - protein, 468 aa, Homo sapiens
  Payload ID: 14168
  Gene Symbol: RORA
  Gene Name: RAR-related orphan receptor A
  ENSP ID: ENSP00000402971
MMYFVIAAMKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 71624 - protein, 62 aa, Homo sapiens
  Payload ID: 14168
  Gene Symbol: RORA
  Gene Name: RAR-related orphan receptor A
  ENSP ID: ENSP00000449482
  MOD_RES (1)..(1): Any amino acid
XPLNQESARKSEPPAPVRRQSYSSTSRGISVTKKTHTWQAWYRALPCTALPMSSSLARRDPL

SEQ ID NO: 71625 - protein, 153 aa, Homo sapiens
  Payload ID: 14168
  Gene Symbol: RORA
  Gene Name: RAR-related orphan receptor A
  ENSP ID: ENSP00000453322
MRVTVAPQTKPVFSTNELAHLSPPSAPASQRESGVGLRASCPTEWGQKVVRGAFRGALRAEKRPAATAQIEIIPCKICGDKSSGIHYGVITCEGCKGFFRRSQQSNATYSCPRQKNCLIDRTSRNRCQHCRLQKCLAVGMSRDAVKFGRMSKK

SEQ ID NO: 71626 - protein, 38 aa, Homo sapiens
  Payload ID: 14168
  Gene Symbol: RORA
  Gene Name: RAR-related orphan receptor A
  ENSP ID: ENSP00000484955
AAAGSRETPLNQESARKSEPPAPVRRQSYSSTSRDWHA

SEQ ID NO: 71627 - protein, 459 aa, Homo sapiens
  Payload ID: 14169
  Gene Symbol: RORB
  Gene Name: RAR-related orphan receptor B
  Uniprot ID: Q92753
  ENSP ID: ENSP00000366093
MRAQIEVIPCKICGDKSSGIHYGVITCEGCKGFFRRSQQNNASYSCPRQRNCLIDRTNRNRCQHCRLQKCLALGMSRDAVKFGRMSKKQRDSLYAEVQKHQQRLQEQRQQQSGEAEALARVYSSSISNGLSNLNNETSGTYANGHVIDLPKSEGYYNVDSGQPSPDQSGLDMTGIKQIKQEPIYDLTSVPNLFTYSSFNNGQLAPGITMTEIDRIAQNIIKSHLETCQYTMEELHQLAWQTHTYEEIKAYQSKSREALWQQCAIQITHAIQYVVEFAKRITGFMELCQNDQILLLKSGCLEVVLVRMCRAFNPLNNTVLFEGKYGGMQMFKALGSDDLVNEAFDFAKNLCSLQLTEEEIALFSSAVLISPDRAWLIEPRKVQKLQEKIYFALQHVIQKNHLDDETLAKLIAKIPTITAVCNLHGEKLQVFKQSHPEIVNTLFPPLYKELFNPDCATGCK

SEQ ID NO: 71628 - protein, 470 aa, Homo sapiens
  Payload ID: 14169
  Gene Symbol: RORB
  Gene Name: RAR-related orphan receptor B
  Uniprot ID: Q92753
  ENSP ID: ENSP00000379507
MCENQLKTKADATAQIEVIPCKICGDKSSGIHYGVITCEGCKGFFRRSQQNNASYSCPRQRNCLIDRTNRNRCQHCRLQKCLALGMSRDAVKFGRMSKKQRDSLYAEVQKHQQRLQEQRQQQSGEAEALARVYSSSISNGLSNLNNETSGTYANGHVIDLPKSEGYYNVDSGQPSPDQSGLDMTGIKQIKQEPIYDLTSVPNLFTYSSFNNGQLAPGITMTEIDRIAQNIIKSHLETCQYTMEELHQLAWQTHTYEEIKAYQSKSREALWQQCAIQITHAIQYVVEFAKRITGFMELCQNDQILLLKSGCLEVVLVRMCRAFNPLNNTVLFEGKYGGMQMFKALGSDDLVNEAFDFAKNLCSLQLTEEEIALFSSAVLISPDRAWLIEPRKVQKLQEKIYFALQHVIQKNHLDDETLAKLIAKIPTITAVCNLHGEKLQVFKQSHPEIVNTLFPPLYKELFNPDCATGCK

SEQ ID NO: 71629 - protein, 518 aa, Homo sapiens
  Payload ID: 14170
  Gene Symbol: RORC
  Gene Name: RAR-related orphan receptor C
  Uniprot ID: P51449
  ENSP ID: ENSP00000327025
MDRAPQRQHRASRELLAAKKTHTSQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 71630 - protein, 497 aa, Homo sapiens
  Payload ID: 14170
  Gene Symbol: RORC
  Gene Name: RAR-related orphan receptor C
  Uniprot ID: P51449
  ENSP ID: ENSP00000349164
MRTQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 71631 - protein, 340 aa, Homo sapiens
  Payload ID: 14171
  Gene Symbol: REM2
  Gene Name: RAS (RAD and GEM)-like GTP binding 2
  Uniprot ID: Q8IYK8
  ENSP ID: ENSP00000267396
MHTDLDTDMDMDTETTALCPSGSRRASPPGTPTPEADATLLKKSEKLLAELDRSGLPSAPGAPRRRGSMPVPYKHQLRRAQAVDELDWPPQASSSGSSDSLGSGEAAPAQKDGIFKVMLVGESGVGKSTLAGTFGGLQGDSAHEPENPEDTYERRIMVDKEEVTLVVYDIWEQGDAGGWLRDHCLQTGDAFLIVFSVTDRRSFSKVPETLLRLRAGRPHHDLPVILVGNKSDLARSREVSLEEGRHLAGTLSCKHIETSAALHHNTRELFEGAVRQIRLRRGRNHAGGQRPDPGSPEGPAPPARRESLTKKAKRFLANLVPRNAKFFKQRSRSCHDLSVL

SEQ ID NO: 71632 - protein, 221 aa, Homo sapiens
  Payload ID: 14171
  Gene Symbol: REM2
  Gene Name: RAS (RAD and GEM)-like GTP binding 2
  Uniprot ID: Q8IYK8
  ENSP ID: ENSP00000442774
MHTDLDTDMDMDTETTALCPSGSRRASPPGTPTPEADATLLKKSEKLLAELDRSGLPSAPGAPRRRGSMPVPYKHQLRRAQAVDELDWPPQASSSGSSDSLGSGEAAPAQKDGIFKVMLVGESGVGKSTLAGTFGGLQGDSAHEPENPGGCRRVAAGPLPSDRGRLSHRLLSHRPTEFLQSSRDPTSAPGWEAAPRPTRYPRWKQERLGPLPGGITGGCVS

SEQ ID NO: 71633 - protein, 298 aa, Homo sapiens
  Payload ID: 14172
  Gene Symbol: REM1
  Gene Name: RAS (RAD and GEM)-like GTP-binding 1
  Uniprot ID: O75628
  ENSP ID: ENSP00000201979
MTLNTEQEAKTPLHRRASTPLPLSPRGHQPGRLSTVPSTQSQHPRLGQSASLNPPTQKPSPAPDDWSSESSDSEGSWEALYRVVLLGDPGVGKTSLASLFAGKQERDLHEQLGEDVYERTLTVDGEDTTLVVVDTWEAEKLDKSWSQESCLQGGSAYVIVYSIADRGSFESASELRIQLRRTHQADHVPIILVGNKADLARCREVSVEEGRACAVVFDCKFIETSATLQHNVAELFEGVVRQLRLRRRDSAAKEPPAPRRPASLAQRARRFLARLTARSARRRALKARSKSCHNLAVL

SEQ ID NO: 71634 - protein, 189 aa, Homo sapiens
  Payload ID: 14173
  Gene Symbol: RASEF
  Gene Name: RAS and EF-hand domain containing
  Uniprot ID: Q8IZ41
  ENSP ID: ENSP00000345651
MEADGDGEELARLRSVFAACDANRSGRLEREEFRALCTELRVRPADAEAVFQRLDADRDGAITFQEFARGFLGSLRGGRRRDWGPLDPAPAVSEAGPETHDSEEDEGDEDAAAALATSCGPASPGRAWQDFQARLGDEAKFIPRFGYTISKPAFVFVRHLITLCALSWAKKEGRETLWTIEEGGAKMAE

SEQ ID NO: 71635 - protein, 740 aa, Homo sapiens
  Payload ID: 14173
  Gene Symbol: RASEF
  Gene Name: RAS and EF-hand domain containing
  Uniprot ID: Q8IZ41
  ENSP ID: ENSP00000365630
MEADGDGEELARLRSVFAACDANRSGRLEREEFRALCTELRVRPADAEAVFQRLDADRDGAITFQEFARGFLGSLRGGRRRDWGPLDPAPAVSEAGPETHDSEEDEGDEDAAAALATSCGPASPGRAWQDFQARLGDEAKFIPREEQVSTLYQNINLVEPRLIQPYEHVIKNFIREIRLQSTEMENLAIAVKRAQDKAAMQLSELEEEMDQRIQAAEHKTRKDEKRKAEEALSDLRRQYETEVGDLQVTIKKLRKLEEQSKRVSQKEDVAALKKQIYDLSMENQKVKKDLLEAQTNIAFLQSELDALKSDYADQSLNTERDLEIIRAYTEDRNSLERQIEILQTANRKLHDSNDGLRSALENSYSKFNRSLHINNISPGNTISRSSPKFIGHSPQPLGYDRSSRSSYVDEDCDSLALCDPLQRTNCEVDSLPESCFDSGLSTLRDPNEYDSEVEYKHQRGFQRSHGVQESFGGDASDTDVPDIRDEETFGLEDVASVLDWKPQGSVSEGSIVSSSRKPISALSPQTDLVDDNAKSFSSQKAYKIVLAGDAAVGKSSFLMRLCKNEFRENISATLGVDFQMKTLIVDGERTVLQLWDTAGQERFRSIAKSYFRKADGVLLLYDVTCEKSFLNIREWVDMIEDAAHETVPIMLVGNKADIRDTAATEGQKCVPGHFGEKLAMTYGALFCETSAKDGSNIVEAVLHLAREVKKRTDKDDSRSITNLTGTNSKKSPQMKNCCNG

SEQ ID NO: 71636 - protein, 783 aa, Homo sapiens
  Payload ID: 14174
  Gene Symbol: RIN1
  Gene Name: Ras and Rab interactor 1
  Uniprot ID: Q13671
  ENSP ID: ENSP00000310406
MESPGESGAGSPGAPSPSSFTTGHLAREKPAQDPLYDVPNASGGQAGGPQRPGRVVSLRERLLLTRPVWLQLQANAAAALHMLRTEPPGTFLVRKSNTRQCQALCMRLPEASGPSFVSSHYILESPGGVSLEGSELMFPDLVQLICAYCHTRDILLLPLQLPRAIHHAATHKELEAISHLGIEFWSSSLNIKAQRGPAGGPVLPQLKARSPQELDQGTGAALCFFNPLFPGDLGPTKREKFKRSFKVRVSTETSSPLSPPAVPPPPVPVLPGAVPSQTERLPPCQLLRRESSVGYRVPAGSGPSLPPMPSLQEVDCGSPSSSEEEGVPGSRGSPATSPHLGRRRPLLRSMSAAFCSLLAPERQVGRAAAALMQDRHTAAGQLVQDLLTQVRAGPEPQELQGIRQALSRARAMLSAELGPEKLLSPKRLEHVLEKSLHCSVLKPLRPILAARLRRRLAADGSLGRLAEGLRLARAQGPGAFGSHLSLPSPVELEQVRQKLLQLLRTYSPSAQVKRLLQACKLLYMALRTQEGEGAGADEFLPLLSLVLAHCDLPELLLEAEYMSELLEPSLLTGEGGYYLTSLSASLALLSGLGQAHTLPLSPVQELRRSLSLWEQRRLPATHCFQHLLRVAYQDPSSGCTSKTLAVPPEASIATLNQLCATKFRVTQPNTFGLFLYKEQGYHRLPPGALAHRLPTTGYLVYRRAEWPETQGAVTEEEGSGQSEARSRGEEQGCQGDGDAGVKASPRDIREQSETTAEGGQGQAQEGPAQPGEPEAEGSRAAEE

SEQ ID NO: 71637 - protein, 80 aa, Homo sapiens
  Payload ID: 14174
  Gene Symbol: RIN1
  Gene Name: Ras and Rab interactor 1
  ENSP ID: ENSP00000431185
MESPGESGAGSPGAPSPSSFTTGHLAREKRSSCGNLTPASARPCACGCLKPVAPPSSPATTSWRALAASPWRARSSCSQT

SEQ ID NO: 71638 - protein, 73 aa, Homo sapiens
  Payload ID: 14174
  Gene Symbol: RIN1
  Gene Name: Ras and Rab interactor 1
  ENSP ID: ENSP00000431550
  MOD_RES (1)..(1): Any amino acid
XLSGVSLEGSELMFPDLVQLICAYCHTRSPEPSTTQPLTKSWRPSPIWALSSGAPPSTSRLSGARLEAQCCPS

SEQ ID NO: 71639 - protein, 617 aa, Homo sapiens
  Payload ID: 14174
  Gene Symbol: RIN1
  Gene Name: Ras and Rab interactor 1
  ENSP ID: ENSP00000432798
MRLPEASGPSFVSSHYILESPGGVSLEGSELMFPDLVQLICAYCHTRDILLLPLQLPRAIHHAATHKELEAISHLGIEFWSSSLNIKAQRGPAGGPVLPQLKARSPQELDQGTGAALCFFNPLFPGDLGPTKREKFKRSFKVRVSTETSSPLSPPAVPPPPVPVLPGAVPSQTERLPPCQLLRRESSVGYRVPAGSGPSLPPMPSLQEVDCGSPSSSEEEGVPGSRGSPATSPHLGRRRPLLRSMSAAFCSLLAPERQVGRAAAALMQDRHTAAGQLVQDLLTQVRAGPEPQELQGIRQALSRARAMLSAELGPEKLLSPKRLVELEQVRQKLLQLLRTYSPSAQVKRLLQACKLLYMALRTQEGEGAGADEFLPLLSLVLAHCDLPELLLEAEYMSELLEPSLLTGEGGYYLTSLSASLALLSGLGQAHTLPLSPVQELRRSLSLWEQRRLPATHCFQHLLRVAYQDPSSGCTSKTLAVPPEASIATLNQLCATKFRVTQPNTFGLFLYKEQGYHRLPPGALAHRLPTTGYLVYRRAEWPETQGAVTEEEGSGQSEARSRGEEQGCQGDGDAGVKASPRDIREQSETTAEGGQGQAQEGPAQPGEPEAEGSRAAEE

SEQ ID NO: 71640 - protein, 80 aa, Homo sapiens; identical to SEQ ID NO: 71637
  Payload ID: 14174
  Gene Symbol: RIN1
  Gene Name: Ras and Rab interactor 1
  ENSP ID: ENSP00000485911

SEQ ID NO: 71641 - protein, 944 aa, Homo sapiens
  Payload ID: 14175
  Gene Symbol: RIN2
  Gene Name: Ras and Rab interactor 2
  Uniprot ID: Q8WYP3
  ENSP ID: ENSP00000255006
MLDSFSQESTLPFREARKRTSFQPVQVWRNFTASQTTESPACSGASLGEMTAWTMGARGLDKRGSFFKLIDTIASEIGELKQEMVRTDVNLENGLEPAETHSMVRHKDGGYSEEEDVKTCARDSGYDSLSNRLSILDRLLHTHPIWLQLSLSEEEAAEVLQAQPPGIFLVHKSTKMQKKVLSLRLPCEFGAPLKEFAIKESTYTFSLEGSGISFADLFRLIAFYCISRDVLPFTLKLPYAISTAKSEAQLEELAQMGLNFWSSPADSKPPNLPPPHRPLSSDGVCPASLRQLCLINGVHSIKTRTPSELECSQTNGALCFINPLFLKVHSQDLSGGLKRPSTRTPNANGTERTRSPPPRPPPPAINSLHTSPRLARTETQTSMPETVNHNKHGNVALPGTKPTPIPPPRLKKQASFLEAEGGAKTLSGGRPGAGPELELGTAGSPGGAPPEAAPGDCTRAPPPSSESRPPCHGGRQRLSDMSISTSSSDSLEFDRSMPLFGYEADTNSSLEDYEGESDQETMAPPIKSKKKRSSSFVLPKLVKSQLQKVSGVFSSFMTPEKRMVRRIAELSRDKCTYFGCLVQDYVSFLQENKECHVSSTDMLQTIRQFMTQVKNYLSQSSELDPPIESLIPEDQIDVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGRMYGADDFLPVLTYVIAQCDMLELDTEIEYMMELLDPSLLHGEGGYYLTSAYGALSLIKNFQEEQAARLLSSETRDTLRQWHKRRTTNRTIPSVDDFQNYLRVAFQEVNSGCTGKTLLVRPYITTEDVCQICAEKFKVGDPEEYSLFLFVDETWQQLAEDTYPQKIKAELHSRPQPHIFHFVYKRIKNDPYGIIFQNGEEDLTTS

SEQ ID NO: 71642 - protein, 462 aa, Homo sapiens
  Payload ID: 14175
  Gene Symbol: RIN2
  Gene Name: Ras and Rab interactor 2
  ENSP ID: ENSP00000391239
MTAWTMGARGLDKRGSFFKLIDTIASEIGELKQEMVRTDVNLENGLEPAETHSMVRHKDGGYSEEEDVKTCARDSGYDSLSNRLSILDRLLHTHPIWLQLSLSEEEAAEVLQAQPPGIFLVHKSTKMQKKVLSLRLPCEFGAPLKEFAIKESTYNVVLEKAMHKCILKPLKGHVEAMLKDFHMADGSWKQLKENLQLVRQRNPQELGVFAPTPDFVDVEKIKVKFMTMQKMYSPEKKVMLLLRVCKLIYTVMENNSGRMYGADDFLPVLTYVIAQCDMLELDTEIEYMMELLDPSLLHGEGGYYLTSAYGALSLIKNFQEEQAARLLSSETRDTLRQWHKRRTTNRTIPSVDDFQNYLRVAFQEVNSGCTGKTLLVRPYITTEDVCQICAEKFKVGDPEEYSLFLFVDETWQQLAEDTYPQKIKAELHSRPQPHIFHFVYKRIKNDPYGIIFQNGEEDLTTS

SEQ ID NO: 71643 - protein, 985 aa, Homo sapiens
  Payload ID: 14176
  Gene Symbol: RIN3
  Gene Name: Ras and Rab interactor 3
  Uniprot ID: Q8TB24
  ENSP ID: ENSP00000216487
MIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSILYLEGSALVFEDIFRLIAFYCVSRDLLPFTLRLPQAILEASSFTDLETIANLGLGFWDSSLNPPQERGKPAEPPRDRAPGFPLVSSLRPTAHDANCACEIELSVGNDRLWFVNPIFIEDCSSALPTDQPPLGNCPARPLPPTSDATSPTSRWAPRRPPPPPPVLPLQPCSPAQPPVLPALAPAPACPLPTSPPVPAPHVTPHAPGPPDHPNQPPMMTCERLPCPTAGLGPLREEAMKPGAASSPLQQVPAPPLPAKKNLPTAPPRRRVSERVSLEDQSPGMAAEGDQLSLPPQGTSDGPEDTPRESTEQGQDTEVKASDPHSMPELPRTAKQPPVPPPRKKRISRQLASTLPAPLENAELCTQAMALETPTPGPPREGQSPASQAGTQHPPAQATAHSQSSPEFKGSLASLSDSLGVSVMATDQDSYSTSSTEEELEQFSSPSVKKKPSMILGKARHRLSFASFSSMFHAFLSNNRKLYKKVVELAQDKGSYFGSLVQDYKVYSLEMMARQTSSTEMLQEIRTMMTQLKSYLLQSTELKALVDPALHSEEELEAIVESALYKCVLKPLKEAINSCLHQIHSKDGSLQQLKENQLVILATTTTDLGVTTSVPEVPMMEKILQKFTSMHKAYSPEKKISILLKTCKLIYDSMALGNPGKPYGADDFLPVLMYVLARSNLTEMLLNVEYMMELMDPALQLGEGSYYLTTTYGALEHIKSYDKITVTRQLSVEVQDSIHRWERRRTLNKARASRSSVQDFICVSYLEPEQQARTLASRADTQAQALCAQCAEKFAVERPQAHRLFVLVDGRCFQLADDALPHCIKGYLLRSEPKRDFHFVYRPLDGGGGGGGGSPPCLVVREPNFL

SEQ ID NO: 71644 - protein, 159 aa, Homo sapiens
  Payload ID: 14176
  Gene Symbol: RIN3
  Gene Name: Ras and Rab interactor 3
  ENSP ID: ENSP00000450682
MIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSKTYCPSHCGYPRPSLRPAASRTLRPSPTWVWVSGTPR

SEQ ID NO: 71645 - protein, 420 aa, Homo sapiens
  Payload ID: 14176
  Gene Symbol: RIN3
  Gene Name: Ras and Rab interactor 3
  ENSP ID: ENSP00000450986
  MOD_RES (1)..(1): Any amino acid
XTQAMALETPTPGPPREGQSPASQAGTQHPPAQATAHSQSSPEFKGSLASLSDSLGVSVMATDQDSYSTSSTEEELEQFSSPSVKKKPSMILGKARHRLSFASFSSMFHAFLSNNRKLYKKVVELAQDKGSYFGSLVQDYKVYSLEMMARQTSSTEMLQEIRTMMTQLKSYLLQSTELKALVDPALHSEEELEAIVESALYKCVLKPLKEAINSCLHQIHSKDGSLQQLKENQLVILATTTTDLGVTTSVPEVPMMEKILQKFTSMHKAYSPEKKISILLKTCKLIYDSMALGNPGKPYGADDFLPVLMYVLARSNLTEMLLNVEYMMELMDPALQLGEGSYYLTTTYGALEHIKSYDKITVTRQLSVEVQDSIHRWERRRTLNKARASRSSVQVRPESGRGPVGPCPRHHPCCLLAKEP

SEQ ID NO: 71646 - protein, 78 aa, Homo sapiens
  Payload ID: 14176
  Gene Symbol: RIN3
  Gene Name: Ras and Rab interactor 3
  ENSP ID: ENSP00000452155
MIRHAGAPARGDPTGPEILDAGFFLSKATSAKTNTIRWEELGIRWGRAPQPSHPLASICHTQDGRVKPERSFSGRKGR

SEQ ID NO: 71647 - protein, 913 aa, Homo sapiens
  Payload ID: 14176
  Gene Symbol: RIN3
  Gene Name: Ras and Rab interactor 3
  ENSP ID: ENSP00000480603
MIRHAGAPARGDPTGPVPVVGKGEEEEEEDGMRLCLPANPKNCLPHRRGISILEKLIKTCPVWLQLSLGQAEVARILHRVVAGMFLVRRDSSSKQLVLCVHFPSLNESSAEVLEYTIKEEKSILYLEGSALVFEDIFRLIAFYCVSRDLLPFTLRLPQAILEASSFTDLETIANLGLGFWDSSLNPPQERGKPAEPPRDRAPGFPLVSSLRPTAHDANCACEIELSVGNDRLWFVNPIFIEDCSSALPTDQPPLGNCPARPLPPTSDATSPTSRWAPRRPPPPPPVLPLQPCSPAQPPVPAPPLPAKKNLPTAPPRRRVSERVSLEDQSPGMAAEGDQLSLPPQGTSDGPEDTPRESTEQGQDTEVKASDPHSMPELPRTAKQPPVPPPRKKRISRQLASTLPAPLENAELCTQAMALETPTPGPPREGQSPASQAGTQHPPAQATAHSQSSPEFKGSLASLSDSLGVSVMATDQDSYSTSSTEEELEQFSSPSVKKKPSMILGKARHRLSFASFSSMFHAFLSNNRKLYKKVVELAQDKGSYFGSLVQDYKVYSLEMMARQTSSTEMLQEIRTMMTQLKSYLLQSTELKALVDPALHSEEELEAIVESALYKCVLKPLKEAINSCLHQIHSKDGSLQQLKENQLVILATTTTDLGVTTSVPEVPMMEKILQKFTSMHKAYSPEKKISILLKTCKLIYDSMALGNPGKPYGADDFLPVLMYVLARSNLTEMLLNVEYMMELMDPALQLGEGSYYLTTTYGALEHIKSYDKITVTRQLSVEVQDSIHRWERRRTLNKARASRSSVQDFICVSYLEPEQQARTLASRADTQAQALCAQCAEKFAVERPQAHRLFVLVDGRCFQLADDALPHCIKGYLLRSEPKRDFHFVYRPLDGGGGGGGGSPPCLVVREPNFL

SEQ ID NO: 71648 - protein, 452 aa, Homo sapiens
  Payload ID: 14177
  Gene Symbol: RINL
  Gene Name: Ras and Rab interactor like
  ENSP ID: ENSP00000488992
MPDLPHLLAFLSASRDVLPRTLLLPPPTLGPRDEHTDPVQIGRVQQDTPGKVLSIVNQLYLETHRGWGREQTPQETEPEAAQRHDPAPRNPAPHGVSWVKGPLSPEVDHPGPALASLLEEEEEDLEGKEEGREDDPEEEGPEDVLTIHVQSLVRARSSYVARQYRSLRVRIASDSGGPHGSGDPATELLQDVRHLLTDLQDHLAKDSYIRAVFGSRGPGLPKKDEDPGPALETAVCQAVLAPLKPALWTRLRTLRAPELRRLRRRQTALRAGAGPPGAQGPGPEGQSPAPALRSRIHERLAHLHAACAPRRKVALLLEVCRDVYAGLARGENQDPLGADAFLPALTEELIWSPDIGDTQLDVEFLMELLDPDELRGEAGYYLTTWFGALHHIAHYQPETDRAPRGLSSEARASLHQWHRRRTLHRKDHPRAQANLPFKEPWAEETVTGTSDN

SEQ ID NO: 71649 - protein, 566 aa, Homo sapiens
  Payload ID: 14177
  Gene Symbol: RINL
  Gene Name: Ras and Rab interactor like
  ENSP ID: ENSP00000489071
MAQPEDKAPEVPTEGVRLVPPQVNKADRTPLGVLSTLEPLTRLQRTWGVWHVPELDTQDAEALVGLWPLGSFLVTGRDPSQALVLRSGPLPGEVNTYQIQKIPRGVSLESSNLCMPDLPHLLAFLSASRDVLPRTLLLPPPTLGPRDEHTDPVQIGRVQQDTPGKVLSIVNQLYLETHRGWGREQTPQETEPEAAQRHDPAPRNPAPHGVSWVKGPLSPEVDHPGPALASLLEEEEEDLEGKEEGREDDPEEEGPEDVLTIHVQSLVRARSSYVARQYRSLRVRIASDSGGPHGSGDPATELLQDVRHLLTDLQDHLAKDSYIRAVFGSRGPGLPKKDEDPGPALETAVCQAVLAPLKPALWTRLRTLRAPELRRLRRRQTALRAGAGPPGAQGPGPEGQSPAPALRSRIHERLAHLHAACAPRRKVALLLEVCRDVYAGLARGENQDPLGADAFLPALTEELIWSPDIGDTQLDVEFLMELLDPDELRGEAGYYLTTWFGALHHIAHYQPETDRAPRGLSSEARASLHQWHRRRTLHRKDHPRAQANLPFKEPWAEETVTGTSDN

SEQ ID NO: 71650 - protein, 54 aa, Homo sapiens
  Payload ID: 14177
  Gene Symbol: RINL
  Gene Name: Ras and Rab interactor like
  ENSP ID: ENSP00000489104
MELLDPDELRGEAGYYLTTWFGALHHIAHYQPETDRAPRGLSSEARASLHQWHR

SEQ ID NO: 71651 - protein, 173 aa, Homo sapiens
  Payload ID: 14177
  Gene Symbol: RINL
  Gene Name: Ras and Rab interactor like
  ENSP ID: ENSP00000489338
  MOD_RES (1)..(1): Any amino acid
XAHLHAACAPRRKVALLLEVCRDVYAGLARGENQDPLGADAFLPALTEELIWSPDIGDTQLDVEFLMELLDPDELRGEAGYYLTTWFGALHHIAHYQPETDRAPRGLSSEARASLHQWHRRRTLHRKDHPRAQVTAHLAASRREGETWCPSDPAPTSPHRPTCPLRSHGQKRL

SEQ ID NO: 71652 - protein, 566 aa, Homo sapiens; identical to SEQ ID NO: 71649
  Payload ID: 14178
  Gene Symbol: RINL
  Gene Name: Ras and Rab interactor-like
  Uniprot ID: Q6ZS11
  ENSP ID: ENSP00000467107

SEQ ID NO: 71653 - protein, 173 aa, Homo sapiens; identical to SEQ ID NO: 71651
  Payload ID: 14178
  Gene Symbol: RINL
  Gene Name: Ras and Rab interactor-like
  ENSP ID: ENSP00000469510
  MOD_RES (1)..(1): Any amino acid

SEQ ID NO: 71654 - protein, 452 aa, Homo sapiens; identical to SEQ ID NO: 71648
  Payload ID: 14178
  Gene Symbol: RINL
  Gene Name: Ras and Rab interactor-like
  Uniprot ID: Q6ZS11
  ENSP ID: ENSP00000469568

SEQ ID NO: 71655 - protein, 54 aa, Homo sapiens; identical to SEQ ID NO: 71650
  Payload ID: 14178
  Gene Symbol: RINL
  Gene Name: Ras and Rab interactor-like
  ENSP ID: ENSP00000470224

SEQ ID NO: 71656 - protein, 644 aa, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENSP ID: ENSP00000311293
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 71657 - protein, 1250 aa, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENSP ID: ENSP00000316543
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKARMESMNRPYTSLVPPLSPQPKIVTPYTASQPSPPLPPPPPPPPPPPPPPPPPPPPLPSQSAPSAGSAAPMFVKYSTITRLQNASQHSGALFKPPTPPVMQSQSVKPQILVPPNGVVPPPPPPPPPPTPGSAMAQLKPAPCAPSLPQFSAPPPPLKIHQVQHITQVAPPTPPPPPPIPAPLPPQAPPKPLVTIPAPTSTKTVAPVVTQAAPPTPTPPVPPAKKQPAFPASYIPPSPPTPPVPVPPPTLPKQQSFCAKPPPSPLSPVPSVVKQIASQFPPPPTPPAMESQPLKPVPANVAPQSPPAVKAKPKWQPSSIPVPSPDFPPPPPESSLVFPPPPPSPVPAPPPPPPPTASPTPDKSGSPGKKTSKTSSPGGKKPPPTPQRNSSIKSSSGAEHPEPKRPSVDSLVSKFTPPAESGSPSKETLPPPAAPPKPGKLNLSGVNLPGVLQQGCVSAKAPVLSGRGKDSVVEFPSPPSDSDFPPPPPETELPLPPIEIPAVFSGNTSPKVAVVNPQPQQWSKMSVKKAPPPTRPKRNDSTRLTQAEISEQPTMATVVPQVPTSPKSSLSVQPGFLADLNRTLQRKSITRHGSLSSRMSRAEPTATMDDMALPPPPPELLSDQQKAGYGGSHISGYATLRRGPPPAPPKRDQNTKLSRDW

SEQ ID NO: 71658 - protein, 1302 aa, Homo sapiens
  Payload ID: 14179
  Gene Symbol: RAPH1
  Gene Name: Ras association (RalGDS/AF-6) and pleckstrin homology domains 1
  ENSP ID: ENSP00000363617
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKARMESMNRPYTSLVPPLSPQPKIVTPYTASQPSPPLPPPPPPPPPPPPPPPPPPPPLPSQSAPSAGSAAPMFVKYSTITRLQNASQHSGALFKPPTPPVMQSQSVKPQILVPPNGVVPPPPPPPPPPTPGSAMAQLKPAPCAPSLPQFSAPPPPLKIHQVQHITQVAPPTPPPPPPIPAPLPPQAPPKPLVTIPAPTSTKTVAPVVTQAAPPTPTPPVPPAKKQPAFPASYIPPSPPTPPVPVPPPTLPKQQSFCAKPPPSPLSPVPSVVKQIASQFPPPPTPPAMESQPLKPVPANVAPQSPPAVKAKPKWQPSSIPVPSPDFPPPPPESSLVFPPPPPSPVPAPPPPPPPTASPTPDKSGSPGKKTSKTSSPGGKKPPPTPQRNSSIKSSSGAEHPEPKRPSVDSLVSKFTPPAESGSPSKETLPPPAAPPKPGKLNLSGVNLPGVLQQGCVSAKAPVLSGRGKDSVVEFPSPPSDSDFPPPPPETELPLPPIEIPAVFSGNTSPKVAVVNPQPQQWSKMSVKKAPPPTRPKRNDSTRLTQAEISEQPTMATVVPQVPTSPKSSLSVQPGFLADLNRTLQRKSITRHGSLSSRMSRAEPTATMDDMALPPPPPELLSDQQKAGYGGSHISGYATLRRGPPPAPPKRDQNTKLSRDW

SEQ ID NO: 71659 - protein, 592 aa, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENSP ID: ENSP00000390578
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 71660 - protein, 594 aa, Homo sapiens
  Payload ID: 14179
  Gene Symbol: RAPH1
  Gene Name: Ras association (RalGDS/AF-6) and pleckstrin homology domains 1
  ENSP ID: ENSP00000392854
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKIN

SEQ ID NO: 71661 - protein, 597 aa, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENSP ID: ENSP00000396711
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKVTASF

SEQ ID NO: 71662 - protein, 619 aa, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENSP ID: ENSP00000397751
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 71663 - protein, 649 aa, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENSP ID: ENSP00000406662
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHAISLRCSSKQAKRHIDFTEEQAELTPHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSKVTASF

SEQ ID NO: 71664 - protein, 617 aa, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENSP ID: ENSP00000411138
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQQSVLEDTKPLVTNQHRRTASAGTVSDAEVHSISNSSHSSITSAASSMDSLDIDKVTRPQELDLTHQGQPITEHSYLDRETSLLLRNIAGKPSHLLTKEEQAAKLKAEKIRVALEKIKEAQVKKLVIRVHMSDDSSKTMMVDERQTVRQVLDNLMDKSHCGYSLDWSLVETVSELQMERIFEDHENLVENLLNWTRDSQNKLIFMERIEKYALFKNPQNYLLGKKETAEMADRNKEVLLEECFCGSSVTVPEIEGVLWLKDDGKKSWKKRYFLLRASGIYYVPKGKAKVSRDLVCFLQLDHVNVYYGQDYRNKYKAPTDYCLVLKHPQIQKKSQYIKYLCCDDVRTLHQWVNGIRIAKYGKQLYMNYQEALKRTESAYDWTSLSSSSIKSGSSSSSIPESQSNHSNQSDSGVSDTQPAGHVRSQSIVSSVFSEAWKRGTQLEESSK

SEQ ID NO: 71665 - protein, 89 aa, Homo sapiens
  Payload ID: 14179
  Gene Symbol: RAPH1
  Gene Name: Ras association (RalGDS/AF-6) and pleckstrin homology domains 1
  ENSP ID: ENSP00000412241
MEQLSDEEIDHGAEEDSDKEDQDLDKMFGAWLGELDKLTQSLDSDKPMEPVKRSPLRQETNMANFSYRFSIYNLNALNQGETVDLDALM

SEQ ID NO: 71666 - protein, 172 aa, Homo sapiens
  Payload ID: 14179
  Gene Symbol: RAPH1
  Gene Name: Ras association (RalGDS/AF-6) and pleckstrin homology domains 1
  ENSP ID: ENSP00000414430
MEQLSDEEIDHGAEEDSDKEDQDLDKMFGAWLGELDKLTQSLDSDKPMEPVKRSPLRQETNMANFSYRFSIYNLNEALNQGETVDLDALMADLCSIEQELSSIGSGNSKRQITETKATQKLPVSRHTLKHGTLKGLSSSSNRIAKPSHASYSLDDVTAQLEQASLSMDEAAQ

SEQ ID NO: 71667 - protein, 1302 aa, Homo sapiens; identical to SEQ ID NO: 71658
  Payload ID: 14179
  Gene Symbol: RAPH1
  Gene Name: Ras association (RalGDS/AF-6) and pleckstrin homology domains 1
  ENSP ID: ENSP00000486548

SEQ ID NO: 71668 - protein, 507 aa, Homo sapiens
  Payload ID: 14180
  Gene Symbol: RASSF10
  Gene Name: Ras association (RalGDS/AF-6) domain family (N-terminal) member 10
  Uniprot ID: A6NK89
  ENSP ID: ENSP00000485526
MDPSEKKISVWICQEEKLVSGLSRRTTCSDVVRVLLEDGCRRRRRQRRSRRLGSAGDPHGPGELPEPPNEDDEDDDEALPQGMLCGPPQCYCIVEKWRGFERILPNKTRILRLWAAWGEEQENVRFVLVRSEASLPNAGPRSAEARVVLSRERPCPARGAPARPSLAMTQEKQRRVVRKAFRKLAKLNRRRQQQTPSSCSSTSSSTASSCSSSPRTHESASVERMETLVHLVLSQDHTIRQQVQRLHELDREIDHYEAKVHLDRMRRHGVNYVQDTYLVGAGIELDGSRPGEEPEEVAAEAEEAAAAPPLAGEAQAAALEELARRCDDLLRLQEQRVQQEELLERLSAEIQEELNQRWMRRRQEELAAREEPLEPDGGPDGELLLEQERVRTQLSTSLYIGLRLNTDLEAVKSDLDYSQQQWDSKKRELQGLLQTLHTLELTVAPDGAPGSGSPSREPGPQACADMWVDQARGLAKSGPGNDEDSDTGLSSMHSQDSDSLPMCESLV

SEQ ID NO: 71669 - protein, 337 aa, Homo sapiens
  Payload ID: 14181
  Gene Symbol: RASSF7
  Gene Name: Ras association (RalGDS/AF-6) domain family (N-terminal) member 7
  Uniprot ID: Q02833
  ENSP ID: ENSP00000380712
MLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 71670 - protein, 373 aa, Homo sapiens
  Payload ID: 14181
  Gene Symbol: RASSF7
  Gene Name: Ras association (RalGDS/AF-6) domain family (N-terminal) member 7
  Uniprot ID: Q02833
  ENSP ID: ENSP00000380713
MLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQGPLPPAREESLLGAPSESHAGAQPRPRGGPHDAELLEVAAAPAPEWCPLAAQPQAL

SEQ ID NO: 71671 - protein, 337 aa, Homo sapiens; identical to SEQ ID NO: 71669
  Payload ID: 14181
  Gene Symbol: RASSF7
  Gene Name: Ras association (RalGDS/AF-6) domain family (N-terminal) member 7
  Uniprot ID: Q02833
  ENSP ID: ENSP00000403068

SEQ ID NO: 71672 - protein, 320 aa, Homo sapiens
  Payload ID: 14181
  Gene Symbol: RASSF7
  Gene Name: Ras association (RalGDS/AF-6) domain family (N-terminal) member 7
  Uniprot ID: Q02833
  ENSP ID: ENSP00000405606
MLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQWPP

SEQ ID NO: 71673 - protein, 120 aa, Homo sapiens
  Payload ID: 14181
  Gene Symbol: RASSF7
  Gene Name: Ras association (RalGDS/AF-6) domain family (N-terminal) member 7
  ENSP ID: ENSP00000413484
MLLGLAAMELKVWVDGIQRVVCGVSEQTTCQEVVIALAQAIDWPLCACAAASGEGAAVAATRVSSGRPGHLRTVCQRCPVCPEAHRAQPSWEALLRQLSTPGTLPNSCQPPCKATGCAGL

SEQ ID NO: 71674 - protein, 83 aa, Homo sapiens
  Payload ID: 14181
  Gene Symbol: RASSF7
  Gene Name: Ras association (RalGDS/AF-6) domain family (N-terminal) member 7
  ENSP ID: ENSP00000433165
MLLGLAAMELKVWVDGIQRVVCGVSEQTTCQEVVIALAQAIGQTGRFVLVQRLREKERQLLPQECPVGAQATCGQFASDVQFV

SEQ ID NO: 71675 - protein, 194 aa, Homo sapiens
  Payload ID: 14181
  Gene Symbol: RASSF7
  Gene Name: Ras association (RalGDS/AF-6) domain family (N-terminal) member 7
  ENSP ID: ENSP00000435885
  MOD_RES (1)..(1): Any amino acid
XVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 71676 - protein, 337 aa, Homo sapiens
  Payload ID: 14181
  Gene Symbol: RASSF7
  Gene Name: Ras association (RalGDS/AF-6) domain family (N-terminal) member 7
  ENSP ID: ENSP00000477800
MLLGLAAMELKVWVDGIQRVVCGVSEQTTCQEVVIALAQAIGQTGRFVLVQRLREKERQLLPQECPVGAQATCGQFASDVQFVLRRTGASLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQVGVVLGGGWEVRTWPSPTPS

SEQ ID NO: 71677 - protein, 320 aa, Homo sapiens [sequence omitted]

SEQ ID NO: 71678 - protein, 373 aa, Homo sapiens
  Payload ID: 14181
  Gene Symbol: RASSF7
  Gene Name: Ras association (RalGDS/AF-6) domain family (N-terminal) member 7
  ENSP ID: ENSP00000480155
MLLGLAAMELKVWVDGIQRVVCGVSEQTTCQEVVIALAQAIGQTGRFVLVQRLREKERQLLPQECPVGAQATCGQFASDVQFVLRRTGASLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQGPLPPAREESLLGAPSESHAGAQPRPRGGPHDAELLEVAAAPAPEWCPLAAQPQAL

SEQ ID NO: 71679 - protein, 337 aa, Homo sapiens; identical to SEQ ID NO: 71676
  Payload ID: 14181
  Gene Symbol: RASSF7
  Gene Name: Ras association (RalGDS/AF-6) domain family (N-terminal) member 7
  ENSP ID: ENSP00000487623

SEQ ID NO: 71680 - protein, 83 aa, Homo sapiens; identical to SEQ ID NO: 71674
  Payload ID: 14181
  Gene Symbol: RASSF7
  Gene Name: Ras association (RalGDS/AF-6) domain family (N-terminal) member 7
  ENSP ID: ENSP00000487959

SEQ ID NO: 71681 - protein, 194 aa, Homo sapiens; identical to SEQ ID NO: 71675
  Payload ID: 14181
  Gene Symbol: RASSF7
  Gene Name: Ras association (RalGDS/AF-6) domain family (N-terminal) member 7
  ENSP ID: ENSP00000488088
  MOD_RES (1)..(1): Any amino acid

SEQ ID NO: 71682 - protein, 120 aa, Homo sapiens
  Payload ID: 14181
  Gene Symbol: RASSF7
  Gene Name: Ras association (RalGDS/AF-6) domain family (N-terminal) member 7
  ENSP ID: ENSP00000488812
MLLGLAAMELKVWVDGIQRVVCGVSEQTTCQEVVIALAQAIDWPLCACAAASGEGAAVAATRVSSGRPGHLRTVCQRCPVCPEAHRGQPSWEALLRQLSTPGTLPNSCQPPCKATGCAGL

SEQ ID NO: 71683 - protein, 419 aa, Homo sapiens
  Payload ID: 14182
  Gene Symbol: RASSF8
  Gene Name: Ras association (RalGDS/AF-6) domain family (N-terminal) member 8
  Uniprot ID: Q8NHQ8
  ENSP ID: ENSP00000282884
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVRLEQKIKRNDVEIEEEEFWENELQIEQENEKQLKDQLQEIRQKITECENKLKDYLAQIRTMESGLEAEKLQREVQEAQVNEEEVKGKIGKVKGEIDIQGQQSLRLENGIKAVERSLGQATKRLQDKEQELEQLTKELRQVNLQQFIQQTGTKVTVLPAEPIEIEASHADIEREAPFQSGSLKRPGSSRQLPSNLRILQNPISSGFNPEGIYV

SEQ ID NO: 71684 - protein, 392 aa, Homo sapiens
  Payload ID: 14182
  Gene Symbol: RASSF8
  Gene Name: Ras association (RalGDS/AF-6) domain family (N-terminal) member 8
  Uniprot ID: Q8NHQ8
  ENSP ID: ENSP00000370756
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVRLEQKIKRNDVEIEEEEFWENELQIEQENEKQLKDQLQEIRQKITECENKLKDYLAQIRTMESGLEAEKLQREVQEAQVNEEEVKGKIGKVKGEIDIQGQQSLRLENGIKAVERSLGQATKRLQDKEQELEQLTKELRQVNLQQFIQQTGTKVTVLPAEPIEIEASHADIERGIIILSDKQECKD

SEQ ID NO: 71685 - protein, 419 aa, Homo sapiens; identical to SEQ ID NO: 71683
  Payload ID: 14182
  Gene Symbol: RASSF8
  Gene Name: Ras association (RalGDS/AF-6) domain family (N-terminal) member 8
  Uniprot ID: Q8NHQ8
  ENSP ID: ENSP00000384491

SEQ ID NO: 71686 - protein, 419 aa, Homo sapiens; identical to SEQ ID NO: 71683
  Payload ID: 14182
  Gene Symbol: RASSF8
  Gene Name: Ras association (RalGDS/AF-6) domain family (N-terminal) member 8
  Uniprot ID: Q8NHQ8
  ENSP ID: ENSP00000439839

SEQ ID NO: 71687 - protein, 122 aa, Homo sapiens
  Payload ID: 14182
  Gene Symbol: RASSF8
  Gene Name: Ras association (RalGDS/AF-6) domain family (N-terminal) member 8
  ENSP ID: ENSP00000441294
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKR

SEQ ID NO: 71688 - protein, 91 aa, Homo sapiens
  Payload ID: 14182
  Gene Symbol: RASSF8
  Gene Name: Ras association (RalGDS/AF-6) domain family (N-terminal) member 8
  ENSP ID: ENSP00000442036
MELKVWVDGVQRIVCGVTEVTTCQEVVIALAQAIGRTGRYTLIEKWRDTERHLAPHENPIISLNKWGQYASDVQLILRRTGPSLSERPTSD

SEQ ID NO: 71689 - protein, 208 aa, Homo sapiens
  Payload ID: 14182
  Gene Symbol: RASSF8
  Gene Name: Ras association (RalGDS/AF-6) domain family (N-terminal) member 8
  ENSP ID: ENSP00000442191
KIKRNDVEIEEEEFWENELQIEQENEKQLKDQLQEIRQKITECENKLKDYLAQIRTMESGLEAEKLQREVQEAQVNEEEVKGKIGKVKGEIDIQGQQSLRLENGIKAVERSLGQATKRLQDKEQELEQLTKELRQVNLQQFIQQTGTKVTVLPAEPIEIEASHADIEREAPFQSGSLKRPGSSRQLPSNLRILQNPISSGFNPEGIYV

SEQ ID NO: 71690 - protein, 219 aa, Homo sapiens
  Payload ID: 14182
  Gene Symbol: RASSF8
  Gene Name: Ras association (RalGDS/AF-6) domain family (N-terminal) member 8
  ENSP ID: ENSP00000442485
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVRLEQKIKRNDVE

SEQ ID NO: 71691 - protein, 419 aa, Homo sapiens; identical to SEQ ID NO: 71683
  Payload ID: 14182
  Gene Symbol: RASSF8
  Gene Name: Ras association (RalGDS/AF-6) domain family (N-terminal) member 8
  Uniprot ID: Q8NHQ8
  ENSP ID: ENSP00000443096

SEQ ID NO: 71692 - protein, 159 aa, Homo sapiens
  Payload ID: 14182
  Gene Symbol: RASSF8
  Gene Name: Ras association (RalGDS/AF-6) domain family (N-terminal) member 8
  ENSP ID: ENSP00000443696
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNC

SEQ ID NO: 71693 - protein, 29 aa, Homo sapiens
  Payload ID: 14182
  Gene Symbol: RASSF8
  Gene Name: Ras association (RalGDS/AF-6) domain family (N-terminal) member 8
  ENSP ID: ENSP00000445434
MELKVWVDGVQRIVCGVTEVTTCQEVVIA

SEQ ID NO: 71694 - protein, 208 aa, Homo sapiens
  Payload ID: 14182
  Gene Symbol: RASSF8
  Gene Name: Ras association (RalGDS/AF-6) domain family (N-terminal) member 8
  ENSP ID: ENSP00000445970
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPPLAKLRPQIDKSIKRREPKRKSLTFTGGAKGLMDIFGKGKETEFKQKVLNNCKTTADELKKLIRLQTEKLQSIEKQLESNEIEIRFWEQKYNSNLEEEIVR

SEQ ID NO: 71695 - protein, 109 aa, Homo sapiens
  Payload ID: 14182
  Gene Symbol: RASSF8
  Gene Name: Ras association (RalGDS/AF-6) domain family (N-terminal) member 8
  ENSP ID: ENSP00000478107
MELKVWVDGVQRIVCGVTEVTTCQEVVIALAQAIGRTGRYTLIEKWRDTERHLAPHENPIISLNKWGQYASDVQLILRRTGPSLSERPTSDSVARIPERTLYRQSLPLS

SEQ ID NO: 71696 - protein, 392 aa, Homo sapiens; identical to SEQ ID NO: 71684
  Payload ID: 14182
  Gene Symbol: RASSF8
  Gene Name: Ras association (RalGDS/AF-6) domain family (N-terminal) member 8
  Uniprot ID: Q8NHQ8
  ENSP ID: ENSP00000481417

SEQ ID NO: 71697 - protein, 435 aa, Homo sapiens
  Payload ID: 14183
  Gene Symbol: RASSF9
  Gene Name: Ras association (RalGDS/AF-6) domain family (N-terminal) member 9
  Uniprot ID: O75901
  ENSP ID: ENSP00000354884
MAPFGRNLLKTRHKNRSPTKDMDSEEKEIVVWVCQEEKLVCGLTKRTTSADVIQALLEEHEATFGEKRFLLGKPSDYCIIEKWRGSERVLPPLTRILKLWKAWGDEQPNMQFVLVKADAFLPVPLWRTAEAKLVQNTEKLWELSPANYMKTLPPDKQKRIVRKTFRKLAKIKQDTVSHDRDNMETLVHLIISQDHTIHQQVKRMKELDLEIEKCEAKFHLDRVENDGENYVQDAYLMPSFSEVEQNLDLQYEENQTLEDLSESDGIEQLEERLKYYRILIDKLSAEIEKEVKSVCIDINEDAEGEAASELESSNLESVKCDLEKSMKAGLKIHSHLSGIQKEIKYSDSLLQMKAKEYELLAKEFNSLHISNKDGCQLKENRAKESEVPSSNGEIPPFTQRVFSNYTNDTDSDTGISSNHSQDSETTVGDVVLLST

SEQ ID NO: 71698 - protein, 270 aa, Homo sapiens
  Payload ID: 14184
  Gene Symbol: RASSF1
  Gene Name: Ras association (RalGDS/AF-6) domain family member 1
  Uniprot ID: Q9NS23
  ENSP ID: ENSP00000333327
MGEAEAPSFEMTWSSTTSSGYCSQEDSDSELEQYFTARTSLARRPRRDQDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 71699 - protein, 344 aa, Homo sapiens
  Payload ID: 14184
  Gene Symbol: RASSF1
  Gene Name: Ras association (RalGDS/AF-6) domain family member 1
  Uniprot ID: Q9NS23
  ENSP ID: ENSP00000349547
MSGEPELIELRELAPAGRAGKGRTRLERANALRIARGTACNPTRQLVPGRGHRFQPAGPATHTWCDLCGDFIWGVVRKGLQCARLSADCKFTCHYRCRALVCLDCCGPRDLGWEPAVERDTNVDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 71700 - protein, 340 aa, Homo sapiens
  Payload ID: 14184
  Gene Symbol: RASSF1
  Gene Name: Ras association (RalGDS/AF-6) domain family member 1
  Uniprot ID: Q9NS23
  ENSP ID: ENSP00000352323
MSGEPELIELRELAPAGRAGKGRTRLERANALRIARGTACNPTRQLVPGRGHRFQPAGPATHTWCDLCGDFIWGVVRKGLQCAHCKFTCHYRCRALVCLDCCGPRDLGWEPAVERDTNVDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 71701 - protein, 92 aa, Homo sapiens
  Payload ID: 14184
  Gene Symbol: RASSF1
  Gene Name: Ras association (RalGDS/AF-6) domain family member 1
  Uniprot ID: Q9NS23
  ENSP ID: ENSP00000378549
MSGEPELIELRELAPAGRAGKGRTRLERANALRIARGTACNPTRQLVPGRGHRFQPAGPATHTWCDLCGDFIWGVVRKGLQCARRACGVGDT

SEQ ID NO: 71702 - protein, 189 aa, Homo sapiens
  Payload ID: 14184
  Gene Symbol: RASSF1
  Gene Name: Ras association (RalGDS/AF-6) domain family member 1
  Uniprot ID: Q9NS23
  ENSP ID: ENSP00000378558
MSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 71703 - protein, 152 aa, Homo sapiens
  Payload ID: 14184
  Gene Symbol: RASSF1
  Gene Name: Ras association (RalGDS/AF-6) domain family member 1
  Uniprot ID: Q9NS23
  ENSP ID: ENSP00000433000
MSGEPELIELRELAPAGRAGKGRTRLERANALRIARGTACNPTRQLVPGRGHRFQPAGPATHTWCDLCGDFIWGVVRKGLQCAQQGRFLHRLHQGSAEAGAPCLCALQQEATLLAGCPAGPRTGHKCQAPHFLLPAQGCCQAPACAVTHKGT

SEQ ID NO: 71704 - protein, 189 aa, Homo sapiens; identical to SEQ ID NO: 71702
  Payload ID: 14184
  Gene Symbol: RASSF1
  Gene Name: Ras association (RalGDS/AF-6) domain family member 1
  Uniprot ID: Q9NS23
  ENSP ID: ENSP00000482696

SEQ ID NO: 71705 - protein, 326 aa, Homo sapiens
  Payload ID: 14185
  Gene Symbol: RASSF2
  Gene Name: Ras association (RalGDS/AF-6) domain family member 2
  Uniprot ID: P50749
  ENSP ID: ENSP00000368684
MDYSHQTSLVPCGQDKYISKNELLLHLKTYNLYYEGQNLQLRHREEEDEFIVEGLLNISWGLRRPIRLQMQDDNERIRPPPSSSSWHSGCNLGAQGTTLKPLTVPKVQISEVDAPPEGDQMPSSTDSRGLKPLQEDTPQLMRTRSDVGVRRRGNVRTPSDQRRIRRHRFSINGHFYNHKTSVFTPAYGSVTNVRINSTMTTPQVLKLLLNKFKIENSAEEFALYVVHTSGEKQKLKATDYPLIARILQGPCEQISKVFLMEKDQVEEVTYDVAQYIKFEMPVLKSFIQKLQEEEDREVKKLMRKYTVLRLMIRQRLEEIAETPATI

SEQ ID NO: 71706 - protein, 326 aa, Homo sapiens; identical to SEQ ID NO: 71705
  Payload ID: 14185
  Gene Symbol: RASSF2
  Gene Name: Ras association (RalGDS/AF-6) domain family member 2
  Uniprot ID: P50749
  ENSP ID: ENSP00000368710

SEQ ID NO: 71707 - protein, 90 aa, Homo sapiens
  Payload ID: 14186
  Gene Symbol: RASSF3
  Gene Name: Ras association (RalGDS/AF-6) domain family member 3
  Uniprot ID: Q86WH2
  ENSP ID: ENSP00000283172
MSSGYSSLEEDAEDFFFTARTSFFRRAPQGKPRSGQQDVEKEKETHSYLSKEEIKEKVHKYNLAVTDKLKMTLSTPASSQTGNIHSTCVW

SEQ ID NO: 71708 - protein, 238 aa, Homo sapiens
  Payload ID: 14186
  Gene Symbol: RASSF3
  Gene Name: Ras association (RalGDS/AF-6) domain family member 3
  Uniprot ID: Q86WH2
  ENSP ID: ENSP00000336616
MSSGYSSLEEDAEDFFFTARTSFFRRAPQGKPRSGQQDVEKEKETHSYLSKEEIKEKVHKYNLAVTDKLKMTLNSNGIYTGFIKVQMELCKPPQTSPNSGKLSPSSNGCMNTLHISSTNTVGEVIEALLKKFLVTESPAKFALYKRCHREDQVYACKLSDREHPLYLRLVAGPRTDTLSFVLREHEIGEWEAFSLPELQNFLRILDKEEDEQLQNLKRRYTAYRQKLEEALREVWKPD

SEQ ID NO: 71709 - protein, 238 aa, Homo sapiens; identical to SEQ ID NO: 71708
  Payload ID: 14186
  Gene Symbol: RASSF3
  Gene Name: Ras association (RalGDS/AF-6) domain family member 3
  Uniprot ID: Q86WH2
  ENSP ID: ENSP00000443021

SEQ ID NO: 71710 - protein, 321 aa, Homo sapiens
  Payload ID: 14187
  Gene Symbol: RASSF4
  Gene Name: Ras association (RalGDS/AF-6) domain family member 4
  Uniprot ID: Q9H2L5
  ENSP ID: ENSP00000339692
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 71711 - protein, 151 aa, Homo sapiens
  Payload ID: 14187
  Gene Symbol: RASSF4
  Gene Name: Ras association (RalGDS/AF-6) domain family member 4
  ENSP ID: ENSP00000409767
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLGCWSLLLGLSSLSLPAAISALQLSVFRKEPSPQNGNITAQGPSIQPVHKAESSTDSS

SEQ ID NO: 71712 - protein, 123 aa, Homo sapiens
  Payload ID: 14187
  Gene Symbol: RASSF4
  Gene Name: Ras association (RalGDS/AF-6) domain family member 4
  ENSP ID: ENSP00000413468
SSHVPISDSKSIQKSELLGLLKTYNCYHEGKSFQLRHREEEGTLIIEGLLNIAWGLRRPIRLQMQDDREQVHLPSTSWMPRRPSCPLHLAGKKGRLQPGGLPTPMQAEHVSPSLVLSLKFTRI

SEQ ID NO: 71713 - protein, 49 aa, Homo sapiens
  Payload ID: 14187
  Gene Symbol: RASSF4
  Gene Name: Ras association (RalGDS/AF-6) domain family member 4
  ENSP ID: ENSP00000473555
MKEDCLPSSHVPISDSKSIQKSELLGLLKTYNCYHEGKSFQLRHREEAQ

SEQ ID NO: 71714 - protein, 84 aa, Homo sapiens
  Payload ID: 14187
  Gene Symbol: RASSF4
  Gene Name: Ras association (RalGDS/AF-6) domain family member 4
  ENSP ID: ENSP00000476848
  MOD_RES (1)..(1): Any amino acid
XTTLQVLTLLLNKFRVEDGPSEFALYIVHESGERTKLKDCEYPLISRILHGPCEKIARIFLMEADLGVEVPHEVSGGQGWGGLL

SEQ ID NO: 71715 - protein, 418 aa, Homo sapiens
  Payload ID: 14188
  Gene Symbol: RASSF5
  Gene Name: Ras association (RalGDS/AF-6) domain family member 5
  Uniprot ID: Q8WWW0
  ENSP ID: ENSP00000462099
MAMASPAIGQRPYPLLLDPEPPRYLQSLSGPELPPPPPDRSSRLCVPAPLSTAPGAREGRSARRAARGNLEPPPRASRPARPLRPGLQQRLRRRPGAPRPRDVRSIFEQPQDPRVPAERGEGHCFAELVLPGGPGWCDLCGREVLRQALRCTNCKFTCHPECRSLIQLDCSQQEGLSRDRPSPESTLTVTFSQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFLTILEKEEQDKIQQVQKKYDKFRQKLEEALRESQGKPG

SEQ ID NO: 71716 - protein, 336 aa, Homo sapiens
  Payload ID: 14188
  Gene Symbol: RASSF5
  Gene Name: Ras association (RalGDS/AF-6) domain family member 5
  Uniprot ID: Q8WWW0
  ENSP ID: ENSP00000462544
MAMASPAIGQRPYPLLLDPEPPRYLQSLSGPELPPPPPDRSSRLCVPAPLSTAPGAREGRSARRAARGNLEPPPRASRPARPLRPGLQQRLRRRPGAPRPRDVRSIFEQPQDPRVPAERGEGHCFAELVLPGGPGWCDLCGREVLRQALRCTNCKFTCHPECRSLIQLDCSQQEGLSRDRPSPESTLTVTFSQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVGCLLHP

SEQ ID NO: 71717 - protein, 265 aa, Homo sapiens
  Payload ID: 14188
  Gene Symbol: RASSF5
  Gene Name: Ras association (RalGDS/AF-6) domain family member 5
  Uniprot ID: Q8WWW0
  ENSP ID: ENSP00000462576
MTVDSSMSSGYCSLDEELEDCFFTAKTTFFRNAQSKHLSKNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFLTILEKEEQDKIQQVQKKYDKFRQKLEEALRESQGKPG

SEQ ID NO: 71718 - protein, 350 aa, Homo sapiens
  Payload ID: 14188
  Gene Symbol: RASSF5
  Gene Name: Ras association (RalGDS/AF-6) domain family member 5
  ENSP ID: ENSP00000464039
MAMASPAIGQRPYPLLLDPEPPRYLQSLSGPELPPPPPDRSSRLCVPAPLSTAPGAREGRSARRAARGNLEPPPRASRPARPLRPGLQQRLRRRPGAPRPRDVRSIFEQPQDPRVPAERGEGHCFAELVLPGGPGWCDLCGREVLRQALRCTNCKFTCHPECRSLIQLDCSQQEGLSRDRPSPESTLTVTFSQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQGRRKSEPNQTVPFLPVSKPTH

SEQ ID NO: 71719 - protein, 185 aa, Homo sapiens
  Payload ID: 14188
  Gene Symbol: RASSF5
  Gene Name: Ras association (RalGDS/AF-6) domain family member 5
  ENSP ID: ENSP00000474142
VCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEVGLDPLCKPRP

SEQ ID NO: 71720 - protein, 337 aa, Homo sapiens
  Payload ID: 14189
  Gene Symbol: RASSF6
  Gene Name: Ras association (RalGDS/AF-6) domain family member 6
  Uniprot ID: Q6ZTQ3
  ENSP ID: ENSP00000303877
MTMMAHQYPSWIFINEKTFITREQLNSLLKTYNIFYENQKNLHILYGETEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHETSIFIPAFESETKVRVNSNMRTEEVIKQLLQKFKIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 71721 - protein, 325 aa, Homo sapiens
  Payload ID: 14189
  Gene Symbol: RASSF6
  Gene Name: Ras association (RalGDS/AF-6) domain family member 6
  Uniprot ID: Q6ZTQ3
  ENSP ID: ENSP00000335582
MLWEETGAAPAPARASDLPYRIHFLSSGLILVTRQLTEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHETSIFIPAFESETKVRVNSNMRTEEVIKQLLQKFKIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 71722 - protein, 369 aa, Homo sapiens
  Payload ID: 14189
  Gene Symbol: RASSF6
  Gene Name: Ras association (RalGDS/AF-6) domain family member 6
  Uniprot ID: Q6ZTQ3
  ENSP ID: ENSP00000340578
MLWEETGAAPAPARASDLPYRISSDHLKKEEKMTMMAHQYPSWIFINEKTFITREQLNSLLKTYNIFYENQKNLHILYGETEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHETSIFIPAFESETKVRVNSNMRTEEVIKQLLQKFKIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 71723 - protein, 303 aa, Homo sapiens
  Payload ID: 14189
  Gene Symbol: RASSF6
  Gene Name: Ras association (RalGDS/AF-6) domain family member 6
  Uniprot ID: Q6ZTQ3
  ENSP ID: ENSP00000379123
MTMMAHQYPSWIFINEKTFITREQLNSLLKTYNIFYENQKNLHILYGETEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHEIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 71724 - protein, 1075 aa, Homo sapiens
  Payload ID: 14190
  Gene Symbol: RADIL
  Gene Name: Ras association and DIL domains
  Uniprot ID: Q96JH8
  ENSP ID: ENSP00000382492
MFYGTHFIMSPPTKSKLKRQSQLLSSMLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVFGDSEKPLLIQELWKPREGLSRRFELRKRSDVEELAAKEVDTITAGINAQARRLQRSRAKGTPTPALGDARSSPPPRLRRTVSETSLSPVNALPAAAQGPEEPGPDAMRYSLYQSPHLLLLQGYSQQHDSLVYVLNRDRHTVGQRTPSSKPSISLSAPDILPLHCTIRRQPLPDSGQAAGRLVLEPIPGAHISVNFSEVGHRTVVLHHGDLLSLGLYYLLLFKDPAQAQPLPARALARLRAVPQSCRLCGAALGARGAASPTQAALPRRQQLLLEFEPHLEDTLLQRIMTLIEPGGDDHKLTPAFLLCLCIQHSATHFQPGTFGQLLLKIARLIRETVWEKTKELAEKQAQLQEPISLASCAMADLVPDLQPILFWMSNSIELLYFIQQKCPLYMQSMEEQLDITGSKESLFSCTLTASEEAMAVLEEVVLYAFQQCVYYVSKSLYICLPALLECPPFQTERRESWSSAPELPEELRRVVSVYQAALDLLRQLQVHPEVASQMLAYLFFFSGTLLLNQLLDRGPSLSCFHWPRGVQACARLQQLLEWMRSAGFGAAGEHFFQKLSCTLNLLATPRAQLIQMSWTALRAAFPALSPAQLHRLLTHYQLASAMGPMSTWEPGAQDSPEAFRSEDVLESYENPPPIVLPSDGFQVDLEANCLDDSIYQHLLYVRHFLWGLRSRASPGSPGRPGSGASQPVCPEGMHHVVLDGHLEAPSCPLAPRDPGPAAREVAPERTLPLRGAPWAQAPPGRQPSRGGSQAGPPHTDSSCLLTPPSTPLGPEPGDPDWPESGGPCGKALPERQRNGLSGLRGAAPEGDSAALAEESPPAPSSRSSSTEDFCYVFTVELERGPSGLGMGLIDGMHTHLGAPGLYIQTLLPGSPAAADGRLSLGDRILEVNGSSLLGLGYLRAVDLIRHGGKKMRFLVAKSDVETAKKIHFRTPPL

SEQ ID NO: 71725 - protein, 134 aa, Homo sapiens
  Payload ID: 14190
  Gene Symbol: RADIL
  Gene Name: Ras association and DIL domains
  ENSP ID: ENSP00000398057
MFYGTHFIMSPPTKSKLKRQSQLLSSMLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVF

SEQ ID NO: 71726 - protein, 407 aa, Homo sapiens
  Payload ID: 14190
  Gene Symbol: RADIL
  Gene Name: Ras association and DIL domains
  ENSP ID: ENSP00000413403
MFYGTHFIMSPPTKSKLKRQSQLLSSMLSRTLSYKYRDLDSTFSSLGASDDPAELSTQLSAPGVLKVFGDSVCTGTHYKSVLATGTSSARELVKEALERYALDPRQAGQYVLCDVVGQAGDAGQRWQARCFRVFGDSEKPLLIQELWKPREGLSRRFELRKRSDVEELAAKEVDTITAGINAQARRLQRSRAKGTPTPALGDARSSPPPRLRRTVSETSLSPVNALPAAAQGPEEPGPDAMRYSLYQSPHLLLLQGYSQQHPGVCAQPGPAHGGPADPLQQAQHQPLSPRHPASTLHHPPATAPGQRPGRGEAGPGAHPRGAHLRQLLRGGAQDRGAAPRGPALPGALLPAAIQGPRAGPAPARPGLGAPPGCAAELPAVRGRARGPGSRLPYSGRPAPAPAAAPGV

SEQ ID NO: 71727 - protein, 329 aa, Homo sapiens
  Payload ID: 14191
  Gene Symbol: RCE1
  Gene Name: Ras converting CAAX endopeptidase 1
  Uniprot ID: Q9Y256
  ENSP ID: ENSP00000309163
MAALGGDGLRLLSVSRPERPPESAALGGLGPGLCCWVSVFSCLSLACSYVGSLYVWKSELPRDHPAVIKRRFTSVLVVSSLSPLCVLLWRELTGIQPGTSLLTLMGFRLEGIFPAALLPLLLTMILFLGPLMQLSMDCPCDLADGLKVVLAPRSWARCLTDMRWLRNQVIAPLTEELVFRACMLPMLAPCMGLGPAVFTCPLFFGVAHFHHIIEQLRFRQSSVGNIFLSAAFQFSYTAVFGAYTAFLFIRTGHLIGPVLCHSFCNYMGFPAVCAALEHPQRRPLLAGYALGVGLFLLLLQPLTDPKLYGSLPLCVLLERAGDSEAPLCS

SEQ ID NO: 71728 - protein, 206 aa, Homo sapiens
  Payload ID: 14191
  Gene Symbol: RCE1
  Gene Name: Ras converting CAAX endopeptidase 1
  ENSP ID: ENSP00000435409
MILFLGPLMQLSMDCPCDLADGLKVVLAPRSWARCLTDMRWLRNQVIAPLTEELVFRACMLPMLAPCMGLGPAVFTCPLFFGVAHFHHIIEQLRFRQSSVGNIFLSAAFQFSYTAVFGAYTAFLFIRTGHLIGPVLCHSFCNYMGFPAVCAALEHPQRRPLLAGYALGVGLFLLLLQPLTDPKLYGSLPLCVLLERAGDSEAPLCS

SEQ ID NO: 71729 - protein, 102 aa, Homo sapiens
  Payload ID: 14191
  Gene Symbol: RCE1
  Gene Name: Ras converting CAAX endopeptidase 1
  ENSP ID: ENSP00000436300
MAALGGDGLRLLSVSRPERPPESAALGGLGPGLCCWVSVFSCLSLACSYVGSLYVWKSELPRDHPAVIKRRFTSVLVVSSLSPLCVLLWRELTGIQAHPCSP

SEQ ID NO: 71730 - protein, 308 aa, Homo sapiens
  Payload ID: 14191
  Gene Symbol: RCE1
  Gene Name: Ras converting CAAX endopeptidase 1
  ENSP ID: ENSP00000436600
MAALGGDGLRLLSVSRPERPPESAALGGLGPGLCCWVSVFSCLSLACSYVGSLYVWKSELPRDHPAVIKRRFTSVLVVSSLSPLCVLLWRELTGIQPGTSLLTLMGFRLEGIFPAALLPLLLTMILFLGPLMQLSMDCPCDLADGLKVVLAPRSWARCLTDMRWLRNQVIAPLTEELVFRACMLPMLAPCMGLGPAVFTCPLFFGVAHFHHIIEQLRFRQSSVGNIFLSAGHLIGPVLCHSFCNYMGFPAVCAALEHPQRRPLLAGYALGVGLFLLLLQPLTDPKLYGSLPLCVLLERAGDSEAPLCS

SEQ ID NO: 71731 - protein, 797 aa, Homo sapiens
  Payload ID: 14192
  Gene Symbol: RASGRP1
  Gene Name: RAS guanyl releasing protein 1 (calcium and DAG-regulated)
  Uniprot ID: O95267
  ENSP ID: ENSP00000310244
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 71732 - protein, 762 aa, Homo sapiens
  Payload ID: 14192
  Gene Symbol: RASGRP1
  Gene Name: RAS guanyl releasing protein 1 (calcium and DAG-regulated)
  Uniprot ID: O95267
  ENSP ID: ENSP00000388540
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 71733 - protein, 481 aa, Homo sapiens
  Payload ID: 14192
  Gene Symbol: RASGRP1
  Gene Name: RAS guanyl releasing protein 1 (calcium and DAG-regulated)
  Uniprot ID: O95267
  ENSP ID: ENSP00000413105
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDSSGE

SEQ ID NO: 71734 - protein, 797 aa, Homo sapiens [sequence omitted]

SEQ ID NO: 71735 - protein, 597 aa, Homo sapiens
  Payload ID: 14192
  Gene Symbol: RASGRP1
  Gene Name: RAS guanyl releasing protein 1 (calcium and DAG-regulated)
  Uniprot ID: O95267
  ENSP ID: ENSP00000452721
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHGNKYSESR

SEQ ID NO: 71736 - protein, 848 aa, Homo sapiens
  Payload ID: 14192
  Gene Symbol: RASGRP1
  Gene Name: RAS guanyl releasing protein 1 (calcium and DAG-regulated)
  ENSP ID: ENSP00000452859
MKVVPTSPTPTDARRPRLGQIWITPVERTSTQAALVQGAGRRAQGTCLRPSPADGYLETPGHRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 71737 - protein, 32 aa, Homo sapiens
  Payload ID: 14192
  Gene Symbol: RASGRP1
  Gene Name: RAS guanyl releasing protein 1 (calcium and DAG-regulated)
  ENSP ID: ENSP00000452892
MMVSLGHLAKGASLDDLIDSCIQSFDADGNLC

SEQ ID NO: 71738 - protein, 811 aa, Homo sapiens
  Payload ID: 14192
  Gene Symbol: RASGRP1
  Gene Name: RAS guanyl releasing protein 1 (calcium and DAG-regulated)
  ENSP ID: ENSP00000453583
IPFLSNLPSERGAARLSPHCLLSFPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 71739 - protein, 123 aa, Homo sapiens
  Payload ID: 14192
  Gene Symbol: RASGRP1
  Gene Name: RAS guanyl releasing protein 1 (calcium and DAG-regulated)
  ENSP ID: ENSP00000453729
ETTYLKPTFCDNCAGFLWGVIKQGYRCKDIRILLLMLRFTDKGYIKSVSSGLHQVRRMLASLGMLSVLAPEDRTDMCDKKALHEFGCETHWGREKSERLLDPGCLVHRLRDELSQTMQRSGCV

SEQ ID NO: 71740 - protein, 96 aa, Homo sapiens
  Payload ID: 14192
  Gene Symbol: RASGRP1
  Gene Name: RAS guanyl releasing protein 1 (calcium and DAG-regulated)
  ENSP ID: ENSP00000453905
MMVSLGHLAKGASLDDLIDSCIQSFDADGNLCRSNQLLQVMLTMHRIVISSAELLQKVITLYKDALAKNSPGLCLKICYFVRYWITEFWVMFKMDA

SEQ ID NO: 71741 - protein, 57 aa, Homo sapiens
  Payload ID: 14192
  Gene Symbol: RASGRP1
  Gene Name: RAS guanyl releasing protein 1 (calcium and DAG-regulated)
  ENSP ID: ENSP00000454005
MMVSLGHLAKGASLDDLIDSCIQSFDADGNLCRSNQLLQVMLTMHRIVISSAELLQK

SEQ ID NO: 71742 - protein, 217 aa, Homo sapiens
  Payload ID: 14192
  Gene Symbol: RASGRP1
  Gene Name: RAS guanyl releasing protein 1 (calcium and DAG-regulated)
  ENSP ID: ENSP00000454053
QNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDRAHGSNHEVAHTILPLRIKRKGRPHQQG

SEQ ID NO: 71743 - protein, 546 aa, Homo sapiens
  Payload ID: 14192
  Gene Symbol: RASGRP1
  Gene Name: RAS guanyl releasing protein 1 (calcium and DAG-regulated)
  Uniprot ID: O95267
  ENSP ID: ENSP00000454164
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKGNKYSESR

SEQ ID NO: 71744 - protein, 609 aa, Homo sapiens
  Payload ID: 14193
  Gene Symbol: RASGRP2
  Gene Name: RAS guanyl releasing protein 2 (calcium and DAG-regulated)
  Uniprot ID: Q7LDG7
  ENSP ID: ENSP00000338864
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPEIREEEVQTVEDGVFDIHL

SEQ ID NO: 71745 - protein, 97 aa, Homo sapiens
  Payload ID: 14193
  Gene Symbol: RASGRP2
  Gene Name: RAS guanyl releasing protein 2 (calcium and DAG-regulated)
  ENSP ID: ENSP00000366705
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELA

SEQ ID NO: 71746 - protein, 148 aa, Homo sapiens
  Payload ID: 14193
  Gene Symbol: RASGRP2
  Gene Name: RAS guanyl releasing protein 2 (calcium and DAG-regulated)
  ENSP ID: ENSP00000366706
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVCVGGAQRAGGALSILYHLCLINVC

SEQ ID NO: 71747 - protein, 148 aa, Homo sapiens; identical to SEQ ID NO: 71746
  Payload ID: 14193
  Gene Symbol: RASGRP2
  Gene Name: RAS guanyl releasing protein 2 (calcium and DAG-regulated)
  ENSP ID: ENSP00000366707

SEQ ID NO: 71748 - protein, 148 aa, Homo sapiens; identical to SEQ ID NO: 71746
  Payload ID: 14193
  Gene Symbol: RASGRP2
  Gene Name: RAS guanyl releasing protein 2 (calcium and DAG-regulated)
  ENSP ID: ENSP00000366709

SEQ ID NO: 71749 - protein, 610 aa, Homo sapiens
  Payload ID: 14193
  Gene Symbol: RASGRP2
  Gene Name: RAS guanyl releasing protein 2 (calcium and DAG-regulated)
  Uniprot ID: Q7LDG7
  ENSP ID: ENSP00000366714
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLSAFGDLDQNQDGCISREEMVSYFLRSSSVLGGRMGFVHNFQESNSLRPVACRHCKALILGIYKQGLKCRACGVNCHKQCKDRLSVECRRRAQSVSLEGSAPSPSPMHSHHHRAFSFSLPRPGRRGSRPPAEIREEEVQTVEDGVFDIHL

SEQ ID NO: 71750 - protein, 609 aa, Homo sapiens; identical to SEQ ID NO: 71744
  Payload ID: 14193
  Gene Symbol: RASGRP2
  Gene Name: RAS guanyl releasing protein 2 (calcium and DAG-regulated)
  Uniprot ID: Q7LDG7
  ENSP ID: ENSP00000366717

SEQ ID NO: 71751 - protein, 63 aa, Homo sapiens
  Payload ID: 14193
  Gene Symbol: RASGRP2
  Gene Name: RAS guanyl releasing protein 2 (calcium and DAG-regulated)
  ENSP ID: ENSP00000377949
MAGTLDLDKGCTVEELLRGCIEAFAGGQAAPHLPTIPEGQLQFPAGENVPPGQVLDLRLPSGV

SEQ ID NO: 71752 - protein, 66 aa, Homo sapiens
  Payload ID: 14193
  Gene Symbol: RASGRP2
  Gene Name: RAS guanyl releasing protein 2 (calcium and DAG-regulated)
  ENSP ID: ENSP00000377950
MAGTLDLDKGCTVEELLRGCIEAFELSGLLNPLLHLPTIPEGQLQFPAGENVPPGQVLDLRLPSGV

SEQ ID NO: 71753 - protein, 148 aa, Homo sapiens; identical to SEQ ID NO: 71746
  Payload ID: 14193
  Gene Symbol: RASGRP2
  Gene Name: RAS guanyl releasing protein 2 (calcium and DAG-regulated)
  ENSP ID: ENSP00000377951

SEQ ID NO: 71754 - protein, 609 aa, Homo sapiens; identical to SEQ ID NO: 71744
  Payload ID: 14193
  Gene Symbol: RASGRP2
  Gene Name: RAS guanyl releasing protein 2 (calcium and DAG-regulated)
  Uniprot ID: Q7LDG7
  ENSP ID: ENSP00000377953

SEQ ID NO: 71755 - protein, 13 aa, Homo sapiens
  Payload ID: 14193
  Gene Symbol: RASGRP2
  Gene Name: RAS guanyl releasing protein 2 (calcium and DAG-regulated)
  ENSP ID: ENSP00000389068
MAGTLDLDKGCTV

SEQ ID NO: 71756 - protein, 126 aa, Homo sapiens
  Payload ID: 14193
  Gene Symbol: RASGRP2
  Gene Name: RAS guanyl releasing protein 2 (calcium and DAG-regulated)
  ENSP ID: ENSP00000396029
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVRL

SEQ ID NO: 71757 - protein, 125 aa, Homo sapiens
  Payload ID: 14193
  Gene Symbol: RASGRP2
  Gene Name: RAS guanyl releasing protein 2 (calcium and DAG-regulated)
  ENSP ID: ENSP00000399028
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVL

SEQ ID NO: 71758 - protein, 232 aa, Homo sapiens
  Payload ID: 14193
  Gene Symbol: RASGRP2
  Gene Name: RAS guanyl releasing protein 2 (calcium and DAG-regulated)
  ENSP ID: ENSP00000399114
MAGTLDLDKGCTVEELLRGCIEAFDDSGKVRDPQLVRMFLMMHPWYIPSSQLAAKLLHIYQQSRKDNSNSLQVKTCHLVRYWISAFPAEFDLNPELAEQIKELKALLDQEGNRRHSSLIDIDSVPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAE

SEQ ID NO: 71759 - protein, 83 aa, Homo sapiens
  Payload ID: 14193
  Gene Symbol: RASGRP2
  Gene Name: RAS guanyl releasing protein 2 (calcium and DAG-regulated)
  ENSP ID: ENSP00000401314
MAGTLDLDKGCTVEELLRGCIEAFDDSGKVRDPQLVRMFLMMHPWYIPSSQLAAKLLHIYQQSRKDNSNSLQVKTCHLVRYWI

SEQ ID NO: 71760 - protein, 63 aa, Homo sapiens; identical to SEQ ID NO: 71751
  Payload ID: 14193
  Gene Symbol: RASGRP2
  Gene Name: RAS guanyl releasing protein 2 (calcium and DAG-regulated)
  ENSP ID: ENSP00000401510

SEQ ID NO: 71761 - protein, 689 aa, Homo sapiens
  Payload ID: 14194
  Gene Symbol: RASGRP3
  Gene Name: RAS guanyl releasing protein 3 (calcium and DAG-regulated)
  Uniprot ID: Q8IV61
  ENSP ID: ENSP00000383917
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSPTSPTTPNKPVVPLEWALGVMPKPDPTVINKHIRKLVESVFRNYDHDHDGYISQEDFESIAANFPFLDSFCVLDKDQDGLISKDEMMAYFLRAKSQLHCKMGPGFIHNFQEMTYLKPTFCEHCAGFLWGIIKQGYKCKDCGANCHKQCKDLLVLACRRFARAPSLSSGHGSLPGSPSLPPAQDEVFEFPGVTAGHRDLDSRAITLVTGSSRKISVRLQRATTSQATQTEPVWSEAGWGDSGSHTFPKMKSKFHDKAAKDKGFAKWENEKPRVHAGVDVVDRGTEFELDQDEGEETRQDGEDG

SEQ ID NO: 71762 - protein, 690 aa, Homo sapiens
  Payload ID: 14194
  Gene Symbol: RASGRP3
  Gene Name: RAS guanyl releasing protein 3 (calcium and DAG-regulated)
  Uniprot ID: Q8IV61
  ENSP ID: ENSP00000384192
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRISFTDYQSYVIHGCLENNPTLERSIALFNGISKWVQLMVLSKPTPQQRAEVITKFINVAKKLLQLKNFNTLMAVVGGLSHSSISRLKETHSHLSSEVTKNWNEMTELVSSNGNYCNYRKAFADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSQPTSPTTPNKPVVPLEWALGVMPKPDPTVINKHIRKLVESVFRNYDHDHDGYISQEDFESIAANFPFLDSFCVLDKDQDGLISKDEMMAYFLRAKSQLHCKMGPGFIHNFQEMTYLKPTFCEHCAGFLWGIIKQGYKCKDCGANCHKQCKDLLVLACRRFARAPSLSSGHGSLPGSPSLPPAQDEVFEFPGVTAGHRDLDSRAITLVTGSSRKISVRLQRATTSQATQTEPVWSEAGWGDSGSHTFPKMKSKFHDKAAKDKGFAKWENEKPRVHAGVDVVDRGTEFELDQDEGEETRQDGEDG

SEQ ID NO: 71763 - protein, 690 aa, Homo sapiens; identical to SEQ ID NO: 71762
  Payload ID: 14194
  Gene Symbol: RASGRP3
  Gene Name: RAS guanyl releasing protein 3 (calcium and DAG-regulated)
  Uniprot ID: Q8IV61
  ENSP ID: ENSP00000385886

SEQ ID NO: 71764 - protein, 113 aa, Homo sapiens
  Payload ID: 14194
  Gene Symbol: RASGRP3
  Gene Name: RAS guanyl releasing protein 3 (calcium and DAG-regulated)
  ENSP ID: ENSP00000388139
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEK

SEQ ID NO: 71765 - protein, 172 aa, Homo sapiens
  Payload ID: 14194
  Gene Symbol: RASGRP3
  Gene Name: RAS guanyl releasing protein 3 (calcium and DAG-regulated)
  ENSP ID: ENSP00000393866
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYEKHVSLIDISSIPSYDWMRRVTQRKKVSKKGKACLLFDHLEPIELAEHLTFLEHKSFRRIS

SEQ ID NO: 71766 - protein, 112 aa, Homo sapiens
  Payload ID: 14194
  Gene Symbol: RASGRP3
  Gene Name: RAS guanyl releasing protein 3 (calcium and DAG-regulated)
  ENSP ID: ENSP00000400602
MGSSGLGKAATLDELLCTCIEMFDDNGELDNSYLPRIVLLMHRWYLSSTELAEKLLCMYRNATGESCNEFRLKICYFMRYWILKFPAEFNLDLGLIRMTEEFREVASQLGYE

SEQ ID NO: 71767 - protein, 34 aa, Homo sapiens
  Payload ID: 14194
  Gene Symbol: RASGRP3
  Gene Name: RAS guanyl releasing protein 3 (calcium and DAG-regulated)
  ENSP ID: ENSP00000401974
MGSSGLGKAATLDELLCTCIEMFDDNGELDNSYL

SEQ ID NO: 71768 - protein, 77 aa, Homo sapiens
  Payload ID: 14194
  Gene Symbol: RASGRP3
  Gene Name: RAS guanyl releasing protein 3 (calcium and DAG-regulated)
  ENSP ID: ENSP00000405648
MGSSGLGKAATLDELLCTCIEMFDDNGELDNSYLPRIVLLMHRWYLSSTELAEKLLCMYRNATGESCNEFRLKICYF

SEQ ID NO: 71769 - protein, 138 aa, Homo sapiens
  Payload ID: 14194
  Gene Symbol: RASGRP3
  Gene Name: RAS guanyl releasing protein 3 (calcium and DAG-regulated)
  ENSP ID: ENSP00000409593
ADCDGFKIPILGVHLKDLIAVHVIFPDWTEENKVNIVKMHQLSVTLSELVSLQNASHHLEPNMDLINLLTLSLDLYHTEDDIYKLSLVLEPRNSKSQPTSPTTPNKPVVPLEWALGVMPKPDPTVINKHIRKLVEVSG

SEQ ID NO: 71770 - protein, 576 aa, Homo sapiens
  Payload ID: 14195
  Gene Symbol: RASGRP4
  Gene Name: RAS guanyl releasing protein 4
  Uniprot ID: Q8TDF6
  ENSP ID: ENSP00000293062
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 71771 - protein, 581 aa, Homo sapiens
  Payload ID: 14195
  Gene Symbol: RASGRP4
  Gene Name: RAS guanyl releasing protein 4
  Uniprot ID: Q8TDF6
  ENSP ID: ENSP00000411878
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 71772 - protein, 639 aa, Homo sapiens
  Payload ID: 14195
  Gene Symbol: RASGRP4
  Gene Name: RAS guanyl releasing protein 4
  Uniprot ID: Q8TDF6
  ENSP ID: ENSP00000416463
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITVMVLSRPGPLQRAQVLDKFIHVAQRLHQLQNFNTLMAVTGGLCHSAISRLKDSHAHLSPDSTKALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 71773 - protein, 484 aa, Homo sapiens
  Payload ID: 14195
  Gene Symbol: RASGRP4
  Gene Name: RAS guanyl releasing protein 4
  Uniprot ID: Q8TDF6
  ENSP ID: ENSP00000445966
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 71774 - protein, 673 aa, Homo sapiens
  Payload ID: 14195
  Gene Symbol: RASGRP4
  Gene Name: RAS guanyl releasing protein 4
  Uniprot ID: Q8TDF6
  ENSP ID: ENSP00000465742
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 71775 - protein, 673 aa, Homo sapiens; identical to SEQ ID NO: 71774
  Payload ID: 14195
  Gene Symbol: RASGRP4
  Gene Name: RAS guanyl releasing protein 4
  Uniprot ID: Q8TDF6
  ENSP ID: ENSP00000465772

SEQ ID NO: 71776 - protein, 659 aa, Homo sapiens
  Payload ID: 14195
  Gene Symbol: RASGRP4
  Gene Name: RAS guanyl releasing protein 4
  Uniprot ID: Q8TDF6
  ENSP ID: ENSP00000466928
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 71777 - protein, 659 aa, Homo sapiens; identical to SEQ ID NO: 71776
  Payload ID: 14195
  Gene Symbol: RASGRP4
  Gene Name: RAS guanyl releasing protein 4
  Uniprot ID: Q8TDF6
  ENSP ID: ENSP00000467604

SEQ ID NO: 71778 - protein, 604 aa, Homo sapiens
  Payload ID: 14195
  Gene Symbol: RASGRP4
  Gene Name: RAS guanyl releasing protein 4
  Uniprot ID: Q8TDF6
  ENSP ID: ENSP00000468483
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 71779 - protein, 581 aa, Homo sapiens; identical to SEQ ID NO: 71771
  Payload ID: 14195
  Gene Symbol: RASGRP4
  Gene Name: RAS guanyl releasing protein 4
  Uniprot ID: Q8TDF6
  ENSP ID: ENSP00000479078

SEQ ID NO: 71780 - protein, 673 aa, Homo sapiens; identical to SEQ ID NO: 71774
  Payload ID: 14195
  Gene Symbol: RASGRP4
  Gene Name: RAS guanyl releasing protein 4
  Uniprot ID: Q8TDF6
  ENSP ID: ENSP00000479844

SEQ ID NO: 71781 - protein, 576 aa, Homo sapiens; identical to SEQ ID NO: 71770
  Payload ID: 14195
  Gene Symbol: RASGRP4
  Gene Name: RAS guanyl releasing protein 4
  Uniprot ID: Q8TDF6
  ENSP ID: ENSP00000479888

SEQ ID NO: 71782 - protein, 617 aa, Homo sapiens
  Payload ID: 14195
  Gene Symbol: RASGRP4
  Gene Name: RAS guanyl releasing protein 4
  ENSP ID: ENSP00000481053
MNRKDSKRKSHQECTGKIGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRGEWGVSEWEGSLGPQAGRMDDTDRTPAAAFPQSAGCVATNTAETR

SEQ ID NO: 71783 - protein, 484 aa, Homo sapiens; identical to SEQ ID NO: 71773
  Payload ID: 14195
  Gene Symbol: RASGRP4
  Gene Name: RAS guanyl releasing protein 4
  Uniprot ID: Q8TDF6
  ENSP ID: ENSP00000484345

SEQ ID NO: 71784 - protein, 184 aa, Homo sapiens
  Payload ID: 14196
  Gene Symbol: RHEB
  Gene Name: Ras homolog enriched in brain
  Uniprot ID: Q15382
  ENSP ID: ENSP00000262187
MPQSKSRKIAILGYRSVGKSSLTIQFVEGQFVDSYDPTIENTFTKLITVNGQEYHLQLVDTAGQDEYSIFPQTYSIDINGYILVYSVTSIKSFEVIKVIHGKLLDMVGKVQIPIMLVGNKKDLHMERVISYEEGKALAESWNAAFLESSAKENQTAVDVFRRIILEAEKMDGAASQGKSSCSVM

SEQ ID NO: 71785 - protein, 19 aa, Homo sapiens
  Payload ID: 14196
  Gene Symbol: RHEB
  Gene Name: Ras homolog enriched in brain
  ENSP ID: ENSP00000417212
MVGKVQIPIMLVGNKKDLH

SEQ ID NO: 71786 - protein, 47 aa, Homo sapiens
  Payload ID: 14196
  Gene Symbol: RHEB
  Gene Name: Ras homolog enriched in brain
  ENSP ID: ENSP00000417802
MPQSKSRKIAILGYRSVGSSSQDLRTCCEWCYSSAGRTGASPWAHLI

SEQ ID NO: 71787 - protein, 79 aa, Homo sapiens
  Payload ID: 14196
  Gene Symbol: RHEB
  Gene Name: Ras homolog enriched in brain
  ENSP ID: ENSP00000418161
MVGKVQIPIMLVGNKKDLHMERVISYEEGKALAESWNAAFLESSAKENQTAVDVFRRIILEAEKMDGAASQGKSSCSVM

SEQ ID NO: 71788 - protein, 79 aa, Homo sapiens; identical to SEQ ID NO: 71787
  Payload ID: 14196
  Gene Symbol: RHEB
  Gene Name: Ras homolog enriched in brain
  ENSP ID: ENSP00000420726

SEQ ID NO: 71789 - protein, 183 aa, Homo sapiens
  Payload ID: 14197
  Gene Symbol: RHEBL1
  Gene Name: Ras homolog enriched in brain like 1
  Uniprot ID: Q8TAI7
  ENSP ID: ENSP00000301068
MPLVRYRKVVILGYRCVGKTSLAHQFVEGEFSEGYDPTVENTYSKIVTLGKDEFHLHLVDTAGQDEYSILPYSFIIGVHGYVLVYSVTSLHSFQVIESLYQKLHEGHGKTRVPVVLVGNKADLSPEREVQAVEGKKLAESWGATFMESSARENQLTQGIFTKVIQEIARVENSYGQERRCHLM

SEQ ID NO: 71790 - protein, 42 aa, Homo sapiens
  Payload ID: 14197
  Gene Symbol: RHEBL1
  Gene Name: Ras homolog enriched in brain like 1
  ENSP ID: ENSP00000409818
MPLVRYRKVVILGYRCVGKTSLAHQFVEGEFSEGYDPTVENR

SEQ ID NO: 71791 - protein, 68 aa, Homo sapiens
  Payload ID: 14197
  Gene Symbol: RHEBL1
  Gene Name: Ras homolog enriched in brain like 1
  Uniprot ID: Q8TAI7
  ENSP ID: ENSP00000446726
MPLVRYRKVVILGYRCVVRKDRGCECGWMIWIQLSHCSPQGRHLWHINLWKASSRKATILQWRILTAR

SEQ ID NO: 71792 - protein, 109 aa, Homo sapiens
  Payload ID: 14197
  Gene Symbol: RHEBL1
  Gene Name: Ras homolog enriched in brain like 1
  ENSP ID: ENSP00000447428
MPLVRYRKVVILGYRCVGKTSLAHQFVEGEFSEGYDPTVENTYSKIVTLGKDEFHLHLVDTAGQVPVGDEYSILPYSFIIGVHGYVLVYSVTSLHSFQVIESLYQKLHE

SEQ ID NO: 71793 - protein, 90 aa, Homo sapiens
  Payload ID: 14198
  Gene Symbol: RHOA
  Gene Name: ras homolog family member A
  ENSP ID: ENSP00000394483
MAAIRKKLVIVGDGACGKTCLLIVFSKDQFPEVYVPTVFENYVADIEVDGKQKTSQKSGPQKSSISVPTCPSSWLGIRRIFGMMSTQGGS

SEQ ID NO: 71794 - protein, 193 aa, Homo sapiens
  Payload ID: 14198
  Gene Symbol: RHOA
  Gene Name: ras homolog family member A
  Uniprot ID: P61586
  ENSP ID: ENSP00000400175
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 71795 - protein, 129 aa, Homo sapiens
  Payload ID: 14198
  Gene Symbol: RHOA
  Gene Name: ras homolog family member A
  ENSP ID: ENSP00000408402
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRR

SEQ ID NO: 71796 - protein, 187 aa, Homo sapiens
  Payload ID: 14198
  Gene Symbol: RHOA
  Gene Name: ras homolog family member A
  ENSP ID: ENSP00000413587
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPHCVARLECCGTILAQLQPPPPRFKRFPCLSLLSSWGYRRPLPHPGAGET

SEQ ID NO: 71797 - protein, 196 aa, Homo sapiens
  Payload ID: 14199
  Gene Symbol: RHOB
  Gene Name: ras homolog family member B
  Uniprot ID: P62745
  ENSP ID: ENSP00000272233
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 71798 - protein, 193 aa, Homo sapiens
  Payload ID: 14200
  Gene Symbol: RHOC
  Gene Name: ras homolog family member C
  Uniprot ID: P08134
  ENSP ID: ENSP00000285735
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 71799 - protein, 193 aa, Homo sapiens; identical to SEQ ID NO: 71798
  Payload ID: 14200
  Gene Symbol: RHOC
  Gene Name: ras homolog family member C
  Uniprot ID: P08134
  ENSP ID: ENSP00000345236

SEQ ID NO: 71800 - protein, 193 aa, Homo sapiens; identical to SEQ ID NO: 71798
  Payload ID: 14200
  Gene Symbol: RHOC
  Gene Name: ras homolog family member C
  Uniprot ID: P08134
  ENSP ID: ENSP00000358646

SEQ ID NO: 71801 - protein, 193 aa, Homo sapiens; identical to SEQ ID NO: 71798
  Payload ID: 14200
  Gene Symbol: RHOC
  Gene Name: ras homolog family member C
  Uniprot ID: P08134
  ENSP ID: ENSP00000358647

SEQ ID NO: 71802 - protein, 199 aa, Homo sapiens
  Payload ID: 14200
  Gene Symbol: RHOC
  Gene Name: ras homolog family member C
  ENSP ID: ENSP00000358650
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRKAGTWRTGSVPLATLSAQPRPRRECGRCLRWPLGLASRSARTSVGGAVPFSEIPKAFPTCPLPSQGYRNYPPTTPAS

SEQ ID NO: 71803 - protein, 193 aa, Homo sapiens; identical to SEQ ID NO: 71798
  Payload ID: 14200
  Gene Symbol: RHOC
  Gene Name: ras homolog family member C
  Uniprot ID: P08134
  ENSP ID: ENSP00000358651

SEQ ID NO: 71804 - protein, 193 aa, Homo sapiens; identical to SEQ ID NO: 71798
  Payload ID: 14200
  Gene Symbol: RHOC
  Gene Name: ras homolog family member C
  Uniprot ID: P08134
  ENSP ID: ENSP00000358652

SEQ ID NO: 71805 - protein, 193 aa, Homo sapiens; identical to SEQ ID NO: 71798
  Payload ID: 14200
  Gene Symbol: RHOC
  Gene Name: ras homolog family member C
  Uniprot ID: P08134
  ENSP ID: ENSP00000358656

SEQ ID NO: 71806 - protein, 188 aa, Homo sapiens
  Payload ID: 14200
  Gene Symbol: RHOC
  Gene Name: ras homolog family member C
  ENSP ID: ENSP00000390823
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRR

SEQ ID NO: 71807 - protein, 91 aa, Homo sapiens
  Payload ID: 14200
  Gene Symbol: RHOC
  Gene Name: ras homolog family member C
  ENSP ID: ENSP00000395791
MAAIRKKLVIVGDGACGKTCLLIVFSKDQFPEVYVPTVFENYIADIEVDGKQVELALWDTAGQEDYDRLRPLSYPDTDVILMCFSIDSPDS

SEQ ID NO: 71808 - protein, 127 aa, Homo sapiens
  Payload ID: 14200
  Gene Symbol: RHOC
  Gene Name: ras homolog family member C
  ENSP ID: ENSP00000399424
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHT

SEQ ID NO: 71809 - protein, 66 aa, Homo sapiens
  Payload ID: 14200
  Gene Symbol: RHOC
  Gene Name: ras homolog family member C
  ENSP ID: ENSP00000431392
MAAIRKKLVIVGDGACGKTCLLIVFSKDQFPEVYVPTVFENYIADIEVDGKQTGSVTWAESLCLWV

SEQ ID NO: 71810 - protein, 66 aa, Homo sapiens; identical to SEQ ID NO: 71809
  Payload ID: 14200
  Gene Symbol: RHOC
  Gene Name: ras homolog family member C
  ENSP ID: ENSP00000432209

SEQ ID NO: 71811 - protein, 66 aa, Homo sapiens; identical to SEQ ID NO: 71809
  Payload ID: 14200
  Gene Symbol: RHOC
  Gene Name: ras homolog family member C
  ENSP ID: ENSP00000434310

SEQ ID NO: 71812 - protein, 129 aa, Homo sapiens
  Payload ID: 14200
  Gene Symbol: RHOC
  Gene Name: ras homolog family member C
  ENSP ID: ENSP00000434877
MVSISGGDLPTGLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSL

SEQ ID NO: 71813 - protein, 169 aa, Homo sapiens
  Payload ID: 14200
  Gene Symbol: RHOC
  Gene Name: ras homolog family member C
  ENSP ID: ENSP00000436240
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVRE

SEQ ID NO: 71814 - protein, 210 aa, Homo sapiens
  Payload ID: 14201
  Gene Symbol: RHOD
  Gene Name: ras homolog family member D
  Uniprot ID: O00212
  ENSP ID: ENSP00000308576
MTAAQAAGEEAPPGVRSVKVVLVGDGGCGKTSLLMVFADGAFPESYTPTVFERYMVNLQVKGKPVHLHIWDTAGQDDYDRLRPLFYPDASVLLLCFDVTSPNSFDNIFNRWYPEVNHFCKKVPIIVVGCKTDLRKDKSLVNKLRRNGLEPVTYHRGQEMARSVGAVAYLECSARLHDNVHAVFQEAAEVALSSRGRNFWRRITQGFCVVT

SEQ ID NO: 71815 - protein, 144 aa, Homo sapiens
  Payload ID: 14201
  Gene Symbol: RHOD
  Gene Name: ras homolog family member D
  ENSP ID: ENSP00000432003
MTAAQAAGEEAPPGVRSVKVVLVGDGGCGKTSLLMVFADGAFPEWYPEVNHFCKKVPIIVVGCKTDLRKDKSLVNKLRRNGLEPVTYHRGQEMARSVGAVAYLECSARLHDNVHAVFQEAAEVALSSRGRNFWRRITQGFCVVT

SEQ ID NO: 71816 - protein, 211 aa, Homo sapiens
  Payload ID: 14202
  Gene Symbol: RHOF
  Gene Name: ras homolog family member F (in filopodia)
  Uniprot ID: Q9HBH0
  ENSP ID: ENSP00000267205
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKWFPEVTHFCRGIPMVLIGCKTDLRKDKEQLRKLRAAQLEPITYMQGLSACEQIRAALYLECSAKFRENVEDVFREAAKVALSALKKAQRQKKRRLCLLL

SEQ ID NO: 71817 - protein, 113 aa, Homo sapiens
  Payload ID: 14202
  Gene Symbol: RHOF
  Gene Name: ras homolog family member F (in filopodia)
  ENSP ID: ENSP00000440397
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKV

SEQ ID NO: 71818 - protein, 111 aa, Homo sapiens
  Payload ID: 14202
  Gene Symbol: RHOF
  Gene Name: ras homolog family member F (in filopodia)
  ENSP ID: ENSP00000476444
MNPTSYDNVLIKWFPEVTHFCRGIPMVLIGCKTDLRKDKEQLRKLRAAQLEPITYMQGLSACEQIRAALYLECSAKFRENVEDVFREAAKVALSALKKAQRQKKRRLCLLL

SEQ ID NO: 71819 - protein, 30 aa, Homo sapiens
  Payload ID: 14202
  Gene Symbol: RHOF
  Gene Name: ras homolog family member F (in filopodia)
  ENSP ID: ENSP00000476574
MNPTSYDNVLIKWFPEVTHFCRGIPMVLIG

SEQ ID NO: 71820 - protein, 75 aa, Homo sapiens
  Payload ID: 14202
  Gene Symbol: RHOF
  Gene Name: ras homolog family member F (in filopodia)
  ENSP ID: ENSP00000476987
MNPTSYDNVLIKWFPEVTHFCRGIPMVLIGCKTDLRKDKEQLRKLRAAQLEPITYMQGLSACEQIRAALYLECSA

SEQ ID NO: 71821 - protein, 170 aa, Homo sapiens
  Payload ID: 14202
  Gene Symbol: RHOF
  Gene Name: ras homolog family member F (in filopodia)
  Uniprot ID: Q9HBH0
  ENSP ID: ENSP00000477391
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKWFPEVTHFCRGIPMVLIGCKTDLRKDKEQLRKLRAAQLEPITYMQVGRGQDPGAQPWL

SEQ ID NO: 71822 - protein, 191 aa, Homo sapiens
  Payload ID: 14203
  Gene Symbol: RHOG
  Gene Name: ras homolog family member G
  Uniprot ID: P84095
  ENSP ID: ENSP00000339467
MQSIKCVVVGDGAVGKTCLLICYTTNAFPKEYIPTVFDNYSAQSAVDGRTVNLNLWDTAGQEEYDRLRTLSYPQTNVFVICFSIASPPSYENVRHKWHPEVCHHCPDVPILLVGTKKDLRAQPDTLRRLKEQGQAPITPQQGQALAKQIHAVRYLECSALQQDGVKEVFAEAVRAVLNPTPIKRGRSCILL

SEQ ID NO: 71823 - protein, 191 aa, Homo sapiens; identical to SEQ ID NO: 71822
  Payload ID: 14203
  Gene Symbol: RHOG
  Gene Name: ras homolog family member G
  Uniprot ID: P84095
  ENSP ID: ENSP00000380175

SEQ ID NO: 71824 - protein, 191 aa, Homo sapiens; identical to SEQ ID NO: 71822
  Payload ID: 14203
  Gene Symbol: RHOG
  Gene Name: ras homolog family member G
  Uniprot ID: P84095
  ENSP ID: ENSP00000380176

SEQ ID NO: 71825 - protein, 191 aa, Homo sapiens; identical to SEQ ID NO: 71822
  Payload ID: 14203
  Gene Symbol: RHOG
  Gene Name: ras homolog family member G
  Uniprot ID: P84095
  ENSP ID: ENSP00000436932

SEQ ID NO: 71826 - protein, 191 aa, Homo sapiens
  Payload ID: 14204
  Gene Symbol: RHOH
  Gene Name: ras homolog family member H
  Uniprot ID: Q15669
  ENSP ID: ENSP00000371219
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCTPVLVVATQTDQREMGPHRASCVNAMEGKKLAQDVRAKGYLECSALSNRGVQQVFECAVRTAVNQARRRNRRRLFSINECKIF

SEQ ID NO: 71827 - protein, 6 aa, Homo sapiens
  Payload ID: 14204
  Gene Symbol: RHOH
  Gene Name: ras homolog family member H
  ENSP ID: ENSP00000420866
MLSSIK

SEQ ID NO: 71828 - protein, 16 aa, Homo sapiens
  Payload ID: 14204
  Gene Symbol: RHOH
  Gene Name: ras homolog family member H
  ENSP ID: ENSP00000422241
MLSSIKCVLVGDSAVG

SEQ ID NO: 71829 - protein, 109 aa, Homo sapiens
  Payload ID: 14204
  Gene Symbol: RHOH
  Gene Name: ras homolog family member H
  ENSP ID: ENSP00000423384
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCT

SEQ ID NO: 71830 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000425010

SEQ ID NO: 71831 - protein, 103 aa, Homo sapiens
  Payload ID: 14204
  Gene Symbol: RHOH
  Gene Name: ras homolog family member H
  ENSP ID: ENSP00000426439
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIR

SEQ ID NO: 71832 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000478248

SEQ ID NO: 71833 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000480192

SEQ ID NO: 71834 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000480379

SEQ ID NO: 71835 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000480772

SEQ ID NO: 71836 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000481566

SEQ ID NO: 71837 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000481746

SEQ ID NO: 71838 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000481836

SEQ ID NO: 71839 - protein, 191 aa, Homo sapiens; identical to SEQ ID NO: 71826
  Payload ID: 14204
  Gene Symbol: RHOH
  Gene Name: ras homolog family member H
  Uniprot ID: Q15669
  ENSP ID: ENSP00000482947

SEQ ID NO: 71840 - protein, 214 aa, Homo sapiens
  Payload ID: 14205
  Gene Symbol: RHOJ
  Gene Name: ras homolog family member J
  Uniprot ID: Q9H4E5
  ENSP ID: ENSP00000316729
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAIGAQCYLECSALTQKGLKAVFDEAILTIFHPKKKKKRCSEGHSCCSII

SEQ ID NO: 71841 - protein, 178 aa, Homo sapiens
  Payload ID: 14205
  Gene Symbol: RHOJ
  Gene Name: ras homolog family member J
  ENSP ID: ENSP00000451643
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVNPASYHNVQEEWVPELKDCMPHVPYVLIGTQIDLRDDPKTLARLLYMKEKPLTYEHGVKLAKAVQSDLNFILNVC

SEQ ID NO: 71842 - protein, 153 aa, Homo sapiens
  Payload ID: 14205
  Gene Symbol: RHOJ
  Gene Name: ras homolog family member J
  ENSP ID: ENSP00000451796
MNCKEGTDSSCGCRGNDEKKMLKCVVVGDGAVGKTCLLMSYANDAFPEEYVPTVFDHYAVTVTVGGKQHLLGLYDTAGQEDYNQLRPLSYPNTDVFLICFSVVWDLPPPHPGMRMAANLCGQAPAKKEGTTRKELPLHGGLPHHPLSPPNTAH

SEQ ID NO: 71843 - protein, 205 aa, Homo sapiens
  Payload ID: 14206
  Gene Symbol: RHOQ
  Gene Name: ras homolog family member Q
  Uniprot ID: P17081
  ENSP ID: ENSP00000238738
MAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 71844 - protein, 50 aa, Homo sapiens
  Payload ID: 14206
  Gene Symbol: RHOQ
  Gene Name: ras homolog family member Q
  ENSP ID: ENSP00000393140
MAHGPGALMLKCVVVGDGAVGKTCLLMSYANDAFPEEYVPTVFDHYAGRL

SEQ ID NO: 71845 - protein, 75 aa, Homo sapiens
  Payload ID: 14206
  Gene Symbol: RHOQ
  Gene Name: ras homolog family member Q
  ENSP ID: ENSP00000428006
MTDVFLICFSVVNPASFQNVKEEWVPELKEYAPNVPFLLIGTQIDLRDDPKTLARLNDMKEKPICVEQGQKLAKE

SEQ ID NO: 71846 - protein, 91 aa, Homo sapiens
  Payload ID: 14206
  Gene Symbol: RHOQ
  Gene Name: ras homolog family member Q
  ENSP ID: ENSP00000428624
PEEYVPTVFDHYAVSVTVGGKQYLLGLYDTAGQALQQSELDFWEEISVSSGSWGHVITFSFHTRAWVSSGQDLLCPLAPASAVLLLDRGRL

SEQ ID NO: 71847 - protein, 34 aa, Homo sapiens
  Payload ID: 14206
  Gene Symbol: RHOQ
  Gene Name: ras homolog family member Q
  ENSP ID: ENSP00000429003
  MOD_RES (1)..(1): Any amino acid
XGGKQYLLGLYDTAGQEDTGELAVRSCDFDKSIF

SEQ ID NO: 71848 - protein, 213 aa, Homo sapiens
  Payload ID: 14206
  Gene Symbol: RHOQ
  Gene Name: ras homolog family member Q
  ENSP ID: ENSP00000484856
MPGAGRSSMAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 71849 - protein, 618 aa, Homo sapiens
  Payload ID: 14207
  Gene Symbol: RHOT1
  Gene Name: ras homolog family member T1
  Uniprot ID: Q8IXI2
  ENSP ID: ENSP00000334724
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHVTQADLKSSTFWLRASFGATVFAVLGFAMYKALLKQR

SEQ ID NO: 71850 - protein, 597 aa, Homo sapiens
  Payload ID: 14207
  Gene Symbol: RHOT1
  Gene Name: ras homolog family member T1
  ENSP ID: ENSP00000346215
MSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHVTQADLKSSTFWLRASFGATVFAVLGFAMYKALLKQR

SEQ ID NO: 71851 - protein, 691 aa, Homo sapiens
  Payload ID: 14207
  Gene Symbol: RHOT1
  Gene Name: ras homolog family member T1
  Uniprot ID: Q8IXI2
  ENSP ID: ENSP00000351132
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPEDHYRDRLSRDMGHTDRIENLRKIWVFLKTAFHARLRCMCTCNRCTFCICQNFLNSDLLQSVKNKIFTAVLNRHVTQADLKSSTFWLRASFGATVFAVLGFAMYKALLKQR

SEQ ID NO: 71852 - protein, 650 aa, Homo sapiens
  Payload ID: 14207
  Gene Symbol: RHOT1
  Gene Name: ras homolog family member T1
  Uniprot ID: Q8IXI2
  ENSP ID: ENSP00000378184
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPEDHYRDRLSRDMGHTDRIENLRKIWVFLKTALHVTQADLKSSTFWLRASFGATVFAVLGFAMYKALLKQR

SEQ ID NO: 71853 - protein, 659 aa, Homo sapiens
  Payload ID: 14207
  Gene Symbol: RHOT1
  Gene Name: ras homolog family member T1
  Uniprot ID: Q8IXI2
  ENSP ID: ENSP00000439737
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHARLRCMCTCNRCTFCICQNFLNSDLLQSVKNKIFTAVLNRHVTQADLKSSTFWLRASFGATVFAVLGFAMYKALLKQR

SEQ ID NO: 71854 - protein, 57 aa, Homo sapiens
  Payload ID: 14207
  Gene Symbol: RHOT1
  Gene Name: ras homolog family member T1
  ENSP ID: ENSP00000461992
MYPHARLRCMCTCNRCTFCICQNFLNSDLLQSVKNKIFTAVLNRHENSPGSLPWRLH

SEQ ID NO: 71855 - protein, 51 aa, Homo sapiens
  Payload ID: 14207
  Gene Symbol: RHOT1
  Gene Name: ras homolog family member T1
  ENSP ID: ENSP00000462612
MKKDVRILLVGEPRVGKTSLIMSLVSEEFPEEIVVDLNTSSFAEYLQPSTK

SEQ ID NO: 71856 - protein, 580 aa, Homo sapiens
  Payload ID: 14207
  Gene Symbol: RHOT1
  Gene Name: ras homolog family member T1
  Uniprot ID: Q8IXI2
  ENSP ID: ENSP00000462669
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYP

SEQ ID NO: 71857 - protein, 51 aa, Homo sapiens; identical to SEQ ID NO: 71855
  Payload ID: 14207
  Gene Symbol: RHOT1
  Gene Name: ras homolog family member T1
  ENSP ID: ENSP00000462698

SEQ ID NO: 71858 - protein, 134 aa, Homo sapiens
  Payload ID: 14207
  Gene Symbol: RHOT1
  Gene Name: ras homolog family member T1
  ENSP ID: ENSP00000463532
  MOD_RES (1)..(1): Any amino acid
XTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHENSPGSLPWRLH

SEQ ID NO: 71859 - protein, 625 aa, Homo sapiens
  Payload ID: 14207
  Gene Symbol: RHOT1
  Gene Name: ras homolog family member T1
  Uniprot ID: Q8IXI2
  ENSP ID: ENSP00000464094
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHARLRCMCTCNRCTFCICQNFLNSDLLQSVKNKIFTAVLNRIISA

SEQ ID NO: 71860 - protein, 40 aa, Homo sapiens
  Payload ID: 14207
  Gene Symbol: RHOT1
  Gene Name: ras homolog family member T1
  ENSP ID: ENSP00000464674
KSFVMLYAWYMMSAIPNPLNTVPGFLRKKLEIIKMANNGR

SEQ ID NO: 71861 - protein, 190 aa, Homo sapiens
  Payload ID: 14207
  Gene Symbol: RHOT1
  Gene Name: ras homolog family member T1
  ENSP ID: ENSP00000464851
  MOD_RES (1)..(1): Any amino acid
XRCNVIGVKNCGKSGVLQALLGRNLMVRRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHARLRCMCTCNRCTFCICQNFLNSDL

SEQ ID NO: 71862 - protein, 156 aa, Homo sapiens
  Payload ID: 14207
  Gene Symbol: RHOT1
  Gene Name: ras homolog family member T1
  ENSP ID: ENSP00000467272
ESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHARLRCMCTCNRCTFCICQNFLNSDLLQSVKNKIFTAVLNRFLTLFTGYQAFC

SEQ ID NO: 71863 - protein, 618 aa, Homo sapiens
  Payload ID: 14208
  Gene Symbol: RHOT2
  Gene Name: ras homolog family member T2
  Uniprot ID: Q8IXI1
  ENSP ID: ENSP00000321971
MRRDVRILLLGEAQVGKTSLILSLVGEEFPEEVPPRAEEITIPADVTPEKVPTHIVDYSEAEQTDEELREEIHKANVVCVVYDVSEEATIEKIRTKWIPLVNGGTTQGPRVPIILVGNKSDLRSGSSMEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 71864 - protein, 135 aa, Homo sapiens
  Payload ID: 14208
  Gene Symbol: RHOT2
  Gene Name: ras homolog family member T2
  ENSP ID: ENSP00000454307
MRRDVRILLLGEAQVGKTSLILSLVGEEFPEEVPPRAEEITIPADVTPEKVPTHIVDYSEAEQTDEELREEIHKANVVCVVYDVSEEATIEKIRTKWIPLVNGGTTQGPSGQQVRPAVGELHGGRAPHHEPVSRD

SEQ ID NO: 71865 - protein, 55 aa, Homo sapiens
  Payload ID: 14208
  Gene Symbol: RHOT2
  Gene Name: ras homolog family member T2
  ENSP ID: ENSP00000454486
MRRDVRILLLGEAQVGKTSLILSLVGEEFPEEKPSRRTRSCGRRSTRFELSGSHW

SEQ ID NO: 71866 - protein, 80 aa, Homo sapiens
  Payload ID: 14208
  Gene Symbol: RHOT2
  Gene Name: ras homolog family member T2
  ENSP ID: ENSP00000455138
MRRDVRILLLGEGGEDVADPVPGGRGVPRGGPSPRGGDHHPRGRHPGEGAHPHRGLLRSRADGRGAAGGDPQGKRGVCGV

SEQ ID NO: 71867 - protein, 208 aa, Homo sapiens
  Payload ID: 14208
  Gene Symbol: RHOT2
  Gene Name: ras homolog family member T2
  ENSP ID: ENSP00000456855
DVRILLLGEAQVGKTSLILSLVGEEFPEEVPPRAEEITIPADVTPEKVPTHIVDYSEAEQTDEELREEIHKIRTKWIPLVNGGTTQGPRVPIILVGNKSDLRSGSSMEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDV

SEQ ID NO: 71868 - protein, 155 aa, Homo sapiens
  Payload ID: 14208
  Gene Symbol: RHOT2
  Gene Name: ras homolog family member T2
  ENSP ID: ENSP00000457437
  MOD_RES (1)..(1): Any amino acid
XTCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAEPRILRALPPFPGPRWPVGMRRAGRQSFGPKAGVGGSPLKFGAVSVVVAEDRRLGS

SEQ ID NO: 71869 - protein, 135 aa, Homo sapiens; identical to SEQ ID NO: 71864
  Payload ID: 14208
  Gene Symbol: RHOT2
  Gene Name: ras homolog family member T2
  ENSP ID: ENSP00000457852

SEQ ID NO: 71870 - protein, 72 aa, Homo sapiens
  Payload ID: 14208
  Gene Symbol: RHOT2
  Gene Name: ras homolog family member T2
  ENSP ID: ENSP00000458136
MRRDVRILLLGEAQVGKTSLILSLVGEEFPEEPSRRTRSCGRRSTRQTWCVWCMTSLRRPPLRRFELSGSHW

SEQ ID NO: 71871 - protein, 214 aa, Homo sapiens
  Payload ID: 14208
  Gene Symbol: RHOT2
  Gene Name: ras homolog family member T2
  ENSP ID: ENSP00000459564
MRRDVRILLLGEAQVGKTSLILSLVGEEFPEEVPPRAEEITIPADVTPEKVPTHIVDYSEAEQTDEELREEIHKANVVCVVYDVSEEATIEKIRTKWIPLVNGGTTQGPRVPIILVGNKSDLRSGSSMEAVLPIMSQFPEIETCVECSAKNLRNISELFYYAQKAVLHPTAPLYDPEAKQKSCFGHPLAPQALEDVKTVVCRNVAGGVREDRLT

SEQ ID NO: 71872 - protein, 258 aa, Homo sapiens
  Payload ID: 14209
  Gene Symbol: RHOU
  Gene Name: ras homolog family member U
  Uniprot ID: Q7L0Q8
  ENSP ID: ENSP00000355652
MPPQQGDPAFPDRCEAPPVPPRRERGGRGGRGPGEPGGRGRAGGAEGRGVKCVLVGDGAVGKTSLVVSYTTNGYPTEYIPTAFDNFSAVVSVDGRPVRLQLCDTAGQDEFDKLRPLCYTNTDIFLLCFSVVSPSSFQNVSEKWVPEIRCHCPKAPIILVGTQSDLREDVKVLIELDKCKEKPVPEEAAKLCAEEIKAASYIECSALTQKNLKEVFDAAIVAGIQYSDTQQQPKKSKSRTPDKMKNLSKSWWKKYCCFV

SEQ ID NO: 71873 - protein, 236 aa, Homo sapiens
  Payload ID: 14210
  Gene Symbol: RHOV
  Gene Name: ras homolog family member V
  Uniprot ID: Q96L33
  ENSP ID: ENSP00000220507
MPPRELSEAEPPPLRAPTPPPRRRSAPPELGIKCVLVGDGAVGKSSLIVSYTCNGYPARYRPTALDTFSVQVLVDGAPVRIELWDTAGQEDFDRLRSLCYPDTDVFLACFSVVQPSSFQNITEKWLPEIRTHNPQAPVLLVGTQADLRDDVNVLIQLDQGGREGPVPQPQAQGLAEKIRACCYLECSALTQKNLKEVFDSAILSAIEHKARLEKKLNAKGVRTLSRCRWKKFFCFV

SEQ ID NO: 71874 - protein, 963 aa, Homo sapiens
  Payload ID: 14211
  Gene Symbol: RASIP1
  Gene Name: Ras interacting protein 1
  Uniprot ID: Q5U651
  ENSP ID: ENSP00000222145
MLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQDFVVYVMTREQHVFGRGGNSSGRGGSPAPYVDTFLNAPDILPRHCTVRAGPEHPAMVRPSRGAPVTHNGCLLLREAELHPGDLLGLGEHFLFMYKDPRTGGSGPARPPWLPARPGATPPGPGWAFSCRLCGRGLQERGEALAAYLDGREPVLRFRPREEEALLGEIVRAAAAGSGDLPPLGPATLLALCVQHSARELELGHLPRLLGRLARLIKEAVWEKIKEIGDRQPENHPEGVPEVPLTPEAVSVELRPLMLWMANTTELLSFVQEKVLEMEKEADQEDPQLCNDLELCDEAMALLDEVIMCTFQQSVYYLTKTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTGDIFESFSSHPPLILPLGSSRLRLTGPVTDDALHRELRRLRRLLWDLEQQELPANYRHGPPVATSP

SEQ ID NO: 71875 - protein, 182 aa, Homo sapiens
  Payload ID: 14211
  Gene Symbol: RASIP1
  Gene Name: Ras interacting protein 1
  ENSP ID: ENSP00000471633
  MOD_RES (1)..(1): Any amino acid
XGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQTLYSTLPALLDSNPFTAGAELPGPGAELGAMPPGLRPTLGVFQ

SEQ ID NO: 71876 - protein, 962 aa, Homo sapiens
  Payload ID: 14211
  Gene Symbol: RASIP1
  Gene Name: Ras interacting protein 1
  ENSP ID: ENSP00000479419
MLSGERKEGGSPRFGKLHLPVGLWINSPRKQLAKLGRRWPSAASVKSSSSDTGSRSSEPLPPPPPHVELRRVGAVKAAGGASGSRAKRISQLFRGSGTGTTGSSGAGGPGTPGGAQRWASEKKLPELAAGVAPEPPLATRATAPPGVLKIFGAGLASGANYKSVLATARSTARELVAEALERYGLAGSPGGGPGESSCVDAFALCDALGRPAAAGVGSGEWRAEHLRVLGDSERPLLVQELWRARPGWARRFELRGREEARRLEQEAFGAADSEGTGAPSWRPQKNRSRAASGGAALASPGPGTGSGAPAGSGGKERSENLSLRRSVSELSLQGRRRRQQERRQQALSMAPGAADAQIGTADPGDFDQLTQCLIQAPSNRPYFLLLQGYQDAQDFVVYVMTREQHVFGRGGNSSGRGGSPAPYVDTFLNAPDILPRHCTVRAGPEHPAMVRPSRGAPVTHNGCLLLREAELHPGDLLGLGEHFLFMYKDPRTGGSGPARPPWLPARPGATRQPWLGFSCRLCGRGLQERGEALAAYLDGREPVLRFRPREEEALLGEIVRAAAAGSGDLPPLGPATLLALCVQHSARELELGHLPRLLGRLARLIKEAVWEKIKEIGDRQPENHPEGVPEVPLTPEAVSVELRPLMLWMANTTELLSFVQEKVLEMEKEADQEDPQLCNDLELCDEAMALLDEVIMCTFQQSVYYLTKTLYSTLPALLDSNPFTAGAELPGPGAELGAMPPGLRPTLGVFQAALELTSQCELHPDLVSQTFGYLFFFSNASLLNSLMERGQGRPFYQWSRAVQIRTNLDLVLDWLQGAGLGDIATEFFRKLSMAVNLLCVPRTSLLKASWSSLRTDHPTLTPAQLHHLLSHYQLGPGRGPPAAWDPPPAEREAVDTGDIFESFSSHPPLILPLGSSRLRLTGPVTDDALHRELRRLRRLLWDLEQQELPANYRHGPPVATSP

SEQ ID NO: 71877 - protein, 1047 aa, Homo sapiens
  Payload ID: 14212
  Gene Symbol: RASA1
  Gene Name: RAS p21 protein activator (GTPase activating protein) 1
  Uniprot ID: P20936
  ENSP ID: ENSP00000274376
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 71878 - protein, 870 aa, Homo sapiens
  Payload ID: 14212
  Gene Symbol: RASA1
  Gene Name: RAS p21 protein activator (GTPase activating protein) 1
  Uniprot ID: P20936
  ENSP ID: ENSP00000411221
MKGWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 71879 - protein, 881 aa, Homo sapiens
  Payload ID: 14212
  Gene Symbol: RASA1
  Gene Name: RAS p21 protein activator (GTPase activating protein) 1
  ENSP ID: ENSP00000420905
MCLVKSWFLSIRSRWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 71880 - protein, 880 aa, Homo sapiens
  Payload ID: 14212
  Gene Symbol: RASA1
  Gene Name: RAS p21 protein activator (GTPase activating protein) 1
  Uniprot ID: P20936
  ENSP ID: ENSP00000422008
MRTGYSSVPSKLRWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 71881 - protein, 539 aa, Homo sapiens
  Payload ID: 14212
  Gene Symbol: RASA1
  Gene Name: RAS p21 protein activator (GTPase activating protein) 1
  Uniprot ID: P20936
  ENSP ID: ENSP00000423395
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRCS

SEQ ID NO: 71882 - protein, 849 aa, Homo sapiens
  Payload ID: 14213
  Gene Symbol: RASA2
  Gene Name: RAS p21 protein activator 2
  Uniprot ID: Q15283
  ENSP ID: ENSP00000286364
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFRGNSLATRCLDEMMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYKRAQGRTRIGKKNFKKRWFCLTSRELTYHKQPGKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKAS

SEQ ID NO: 71883 - protein, 853 aa, Homo sapiens [sequence omitted]

SEQ ID NO: 71884 - protein, 47 aa, Homo sapiens
  Payload ID: 14213
  Gene Symbol: RASA2
  Gene Name: RAS p21 protein activator 2
  ENSP ID: ENSP00000424293
MAAAAPAAAAASSEAPAASATAEPEAGDQDSREVKQKIYCHILDPTK

SEQ ID NO: 71885 - protein, 834 aa, Homo sapiens
  Payload ID: 14214
  Gene Symbol: RASA3
  Gene Name: RAS p21 protein activator 3
  Uniprot ID: Q14644
  ENSP ID: ENSP00000335029
MAVEDEGLRVFQSVKIKIGEAKNLPSYPGPSKMRDCYCTVNLDQEEVFRTKIVEKSLCPFYGEDFYCEIPRSFRHLSFYIFDRDVFRRDSIIGKVAIQKEDLQKYHNRDTWFQLQHVDADSEVQGKVHLELRLSEVITDTGVVCHKLATRIVECQGLPIVNGQCDPYATVTLAGPFRSEAKKTKVKRKTNNPQFDEVFYFEVTRPCSYSKKSHFDFEEEDVDKLEIRVDLWNASNLKFGDEFLGELRIPLKVLRQSSSYEAWYFLQPRDNGSKSLKPDDLGSLRLNVVYTEDHVFSSDYYSPLRDLLLKSADVEPVSASAAHILGEVCREKQEAAVPLVRLFLHYGRVVPFISAIASAEVKRTQDPNTIFRGNSLASKCIDETMKLAGMHYLHVTLKPAIEEICQSHKPCEIDPVKLKDGENLENNMENLRQYVDRVFHAITESGVSCPTVMCDIFFSLREAAAKRFQDDPDVRYTAVSSFIFLRFFAPAILSPNLFQLTPHHTDPQTSRTLTLISKTVQTLGSLSKSKSASFKESYMATFYEFFNEQKYADAVKNFLDLISSSGRRDPKSVEQPIVLKEGFMIKRAQGRKRFGMKNFKKRWFRLTNHEFTYHKSKGDQPLYSIPIENILAVEKLEEESFKMKNMFQVIQPERALYIQANNCVEAKDWIDILTKVSQCNQKRLTVYHPSAYLSGHWLCCRAPSDSAPGCSPCTGGLPANIQLDIDGDRETERIYSLFNLYMSKLEKMQEACGSKSVYDGPEQEEYSTFVIDDPQETYKTLKQVIAGVGALEQEHAQYKRDKFKKTKYGSQEHPIGDKSFQNYIRQQSETSTHSI

SEQ ID NO: 71886 - protein, 834 aa, Homo sapiens; identical to SEQ ID NO: 71885
  Payload ID: 14214
  Gene Symbol: RASA3
  Gene Name: RAS p21 protein activator 3
  ENSP ID: ENSP00000486064

SEQ ID NO: 71887 - protein, 803 aa, Homo sapiens
  Payload ID: 14215
  Gene Symbol: RASA4
  Gene Name: RAS p21 protein activator 4
  Uniprot ID: O43374
  ENSP ID: ENSP00000262940
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 71888 - protein, 757 aa, Homo sapiens
  Payload ID: 14215
  Gene Symbol: RASA4
  Gene Name: RAS p21 protein activator 4
  Uniprot ID: O43374
  ENSP ID: ENSP00000412876
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 71889 - protein, 731 aa, Homo sapiens
  Payload ID: 14215
  Gene Symbol: RASA4
  Gene Name: RAS p21 protein activator 4
  ENSP ID: ENSP00000417395
MDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 71890 - protein, 731 aa, Homo sapiens; identical to SEQ ID NO: 71889
  Payload ID: 14215
  Gene Symbol: RASA4
  Gene Name: RAS p21 protein activator 4
  ENSP ID: ENSP00000420352

SEQ ID NO: 71891 - protein, 54 aa, Homo sapiens
  Payload ID: 14215
  Gene Symbol: RASA4
  Gene Name: RAS p21 protein activator 4
  ENSP ID: ENSP00000428448
MDEDALSRDDVIGKVCLTRDTIASHPKGIWPQRTAMAHLTPSSECATRAGHGRP

SEQ ID NO: 71892 - protein, 273 aa, Homo sapiens
  Payload ID: 14215
  Gene Symbol: RASA4
  Gene Name: RAS p21 protein activator 4
  ENSP ID: ENSP00000428605
  MOD_RES (1)..(1): Any amino acid
XCRQDVATNLLKLFLGQGLAKDFLDLLFQLELSRTSETNTLFRSNSLASKSMESFLKVAGMQYLHGVLGPIINKVFEEKKCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSS

SEQ ID NO: 71893 - protein, 98 aa, Homo sapiens
  Payload ID: 14215
  Gene Symbol: RASA4
  Gene Name: RAS p21 protein activator 4
  ENSP ID: ENSP00000428732
MDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETS

SEQ ID NO: 71894 - protein, 137 aa, Homo sapiens
  Payload ID: 14215
  Gene Symbol: RASA4
  Gene Name: RAS p21 protein activator 4
  ENSP ID: ENSP00000430337
  MOD_RES (1)..(1): Any amino acid
XPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDDWRCGCGTRRCCPPATTSHWCTCCATRSSWACRAQGS

SEQ ID NO: 71895 - protein, 306 aa, Homo sapiens
  Payload ID: 14215
  Gene Symbol: RASA4
  Gene Name: RAS p21 protein activator 4
  ENSP ID: ENSP00000430418
MAKRSSLYIRIVEGKNLPAKDMTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLD

SEQ ID NO: 71896 - protein, 160 aa, Homo sapiens [sequence omitted]

SEQ ID NO: 71897 - protein, 731 aa, Homo sapiens
  Payload ID: 14216
  Gene Symbol: RASA4B
  Gene Name: RAS p21 protein activator 4B
  ENSP ID: ENSP00000303968
MDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSVESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVHQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 71898 - protein, 803 aa, Homo sapiens
  Payload ID: 14216
  Gene Symbol: RASA4B
  Gene Name: RAS p21 protein activator 4B
  Uniprot ID: C9J798
  ENSP ID: ENSP00000417895
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSVESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVHQGVAQLKDFITKLVDIEEKDELDLQRTLSLQAPPVKEGPLFIHRTKGKGPLMSSSFKKLYFSLTTEALSFAKTPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 71899 - protein, 757 aa, Homo sapiens
  Payload ID: 14216
  Gene Symbol: RASA4B
  Gene Name: RAS p21 protein activator 4B
  ENSP ID: ENSP00000440982
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSVESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVHQGVAQLKDFITKLVDIEEKDELDLQRTLSLQAPPVKEGPLFIHRTKGKGPLMSSSFKKLYFSLTTEALSFAKTPSSKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGAEAGTVPTSPGKVPEDSLARLLRVLQDLREAHSSSPAGSPPSEPNCLLELQT

SEQ ID NO: 71900 - protein, 804 aa, Homo sapiens
  Payload ID: 14217
  Gene Symbol: RASAL1
  Gene Name: RAS protein activator like 1 (GAP1 like)
  Uniprot ID: O95294
  ENSP ID: ENSP00000261729
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 71901 - protein, 776 aa, Homo sapiens
  Payload ID: 14217
  Gene Symbol: RASAL1
  Gene Name: RAS protein activator like 1 (GAP1 like)
  Uniprot ID: O95294
  ENSP ID: ENSP00000395920
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 71902 - protein, 805 aa, Homo sapiens
  Payload ID: 14217
  Gene Symbol: RASAL1
  Gene Name: RAS protein activator like 1 (GAP1 like)
  Uniprot ID: O95294
  ENSP ID: ENSP00000448510
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 71903 - protein, 806 aa, Homo sapiens
  Payload ID: 14217
  Gene Symbol: RASAL1
  Gene Name: RAS protein activator like 1 (GAP1 like)
  Uniprot ID: O95294
  ENSP ID: ENSP00000450244
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 71904 - protein, 1280 aa, Homo sapiens
  Payload ID: 14218
  Gene Symbol: RASAL2
  Gene Name: RAS protein activator like 2
  Uniprot ID: Q9UJF2
  ENSP ID: ENSP00000356621
MELSPSSGGAAEALSWPEMFPALESDSPLPPEDLDAVVPVSGAVAGGMLDRILLESVCQQQSWVRVYDVKGPPTHRLSCGQSPYTETTTWERKYCILTDSQLVLLNKEKEIPVEGGQEQQTDSTKGRCLRRTVSVPSEGQFPEYPPEGATKLEVPAERSPRRRSISGTSTSEKPNSMDTANTSPFKVPGFFSKRLKGSIKRTKSQSKLDRNTSFRLPSLRSTDDRSRGLPKLKESRSHESLLSPCSTVECLDLGRGEPVSVKPLHSSILGQDFCFEVTYLSGSKCFSCNSASERDKWMENLRRTVQPNKDNCRRAENVLRLWIIEAKDLAPKKKYFCELCLDDTLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQEKRIVSLDSANTRLMSALTQVKERYSMQVRNGISPTNPTKLSITENGEFKNSSC

SEQ ID NO: 71905 - protein, 693 aa, Homo sapiens
  Payload ID: 14218
  Gene Symbol: RASAL2
  Gene Name: RAS protein activator like 2
  ENSP ID: ENSP00000402897
  MOD_RES (1)..(1): Any amino acid
XEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQVINGDEIIQTGKTDRVPGFSQHQTDERADPSEGAVQHAGPQWHLPHQPHQAFHHGEW

SEQ ID NO: 71906 - protein, 1139 aa, Homo sapiens
  Payload ID: 14218
  Gene Symbol: RASAL2
  Gene Name: RAS protein activator like 2
  Uniprot ID: Q9UJF2
  ENSP ID: ENSP00000420558
MQTPEVPAERSPRRRSISGTSTSEKPNSMDTANTSPFKVPGFFSKRLKGSIKRTKSQSKLDRNTSFRLPSLRSTDDRSRGLPKLKESRSHESLLSPCSTVECLDLGRGEPVSVKPLHSSILGQDFCFEVTYLSGSKCFSCNSASERDKWMENLRRTVQPNKDNCRRAENVLRLWIIEAKDLAPKKKYFCELCLDDTLFARTTSKTKADNIFWGEHFEFFSLPPLHSITVHIYKDVEKKKKKDKNNYVGLVNIPTASVTGRQFVEKWYPVSTPTPNKGKTGGPSIRIKSRFQTITILPMEQYKEFAEFVTSNYTMLCSVLEPVISVRNKEELACALVHILQSTGRAKDFLTDLVMSEVDRCGEHDVLIFRENTIATKSIEEYLKLVGQQYLHDALGEFIKALYESDENCEVDPSKCSSSELIDHQSNLKMCCELAFCKIINSYCVFPRELKEVFASWKQQCLNRGKQDISERLISASLFLRFLCPAIMSPSLFNLMQEYPDDRTSRTLTLIAKVIQNLANFAKFGNKEEYMAFMNDFLEHEWGGMKRFLLEISNPDTISNTPGFDGYIDLGRELSVLHSLLWEVVSQLDKGENSFLQATVAKLGPLPRVLADITKSLTNPTPIQQQLRRFTEHNSSPNVSGSLSSGLQKIFEDPTDSDLHKLKSPSQDNTDSYFRGKTLLLVQQASSQSMTYSEKDERESSLPNGRSVSLMDLQDTHAAQVEHASVMLDVPIRLTGSQLSITQVASIKQLRETQSTPQSAPQVRRPLHPALNQPGGLQPLSFQNPVYHLNNPIPAMPKASIDSSLENLSTASSRSQSNSEDFKLSGPSNSSMEDFTKRSTQSEDFSRRHTVPDRHIPLALPRQNSTGQAQIRKVDQGGLGARAKAPPSLPHSASLRSTGSMSVVSAALVAEPVQNGSRSRQQSSSSRESPVPKVRAIQRQQTQQVQSPVDSATMSPVERTAAWVLNNGQYEEDVEETEQNLDEAKHAEKYEQEITKLKERLRVSSRRLEEYERRLLVQEQQMQKLLLEYKARLEDSEERLRRQQEEKDSQMKSIISRLMAVEEELKKDHAEMQAVIDAKQKIIDAQEKRIVSLDSANTRLMSALTQVKERYSMQVRNGISPTNPTKLSITENGEFKNSSC

SEQ ID NO: 71907 - protein, 1011 aa, Homo sapiens
  Payload ID: 14219
  Gene Symbol: RASAL3
  Gene Name: RAS protein activator like 3
  Uniprot ID: Q86YV0
  ENSP ID: ENSP00000341905
MDPPSPSRTSQTQPTATSPLTSYRWHTGGGGEKAAGGFRWGRFAGWGRALSHQEPMVSTQPAPRSIFRRVLSAPPKESRTSRLRLSKALWGRHKNPPPEPDPEPEQEAPELEPEPELEPPTPQIPEAPTPNVPVWDIGGFTLLDGKLVLLGGEEEGPRRPRVGSASSEGSIHVAMGNFRDPDRMPGKTEPETAGPNQVHNVRGLLKRLKEKKKARLEPRDGPPSALGSRESLATLSELDLGAERDVRIWPLHPSLLGEPHCFQVTWTGGSRCFSCRSAAERDRWIEDLRRQFQPTQDNVEREETWLSVWVHEAKGLPRAAAGAPGVRAELWLDGALLARTAPRAGPGQLFWAERFHFEALPPARRLSLRLRGLGPGSAVLGRVALALEELDAPRAPAAGLERWFPLLGAPAGAALRARIRARRLRVLPSERYKELAEFLTFHYARLCGALEPALPAQAKEELAAAMVRVLRATGRAQALVTDLGTAELARCGGREALLFRENTLATKAIDEYMKLVAQDYLQETLGQVVRRLCASTEDCEVDPSKCPASELPEHQARLRNSCEEVFETIIHSYDWFPAELGIVFSSWREACKERGSEVLGPRLVCASLFLRLLCPAILAPSLFGLAPDHPAPGPARTLTLIAKVIQNLANRAPFGEKEAYMGFMNSFLEEHGPAMQCFLDQVAMVDVDAAPSGYQGSGDLALQLAVLHAQLCTIFAELDQTTRDTLEPLPTILRAIEEGQPVLVSVPMRLPLPPAQVHSSLSAGEKPGFLAPRDLPKHTPLISKSQSLRSVRRSESWARPRPDEERPLRRPRPVQRTQSVPVRRPARRRQSAGPWPRPKGSLSMGPAPRARPWTRDSASLPRKPSVPWQRQMDQPQDRNQALGTHRPVNKLAELQCEVAALREEQKVLSRLVESLSTQIRALTEQQEQLRGQLQDLDSRLRAGSSEFDSEHNLTSNEGHSLKNLEHRLNEMERTQAQLRDAVQSLQLSPRTRGSWSQPQPLKAPCLNGDTT

SEQ ID NO: 71908 - protein, 445 aa, Homo sapiens
  Payload ID: 14219
  Gene Symbol: RASAL3
  Gene Name: RAS protein activator like 3
  ENSP ID: ENSP00000468841
  MOD_RES (1)..(1): Any amino acid
XREALLFRENTLATKAIDEYMKLVAQDYLQETLGQVVRRLCASTEDCEVDPSKCPASELPEHQARLRNSCEEVFETIIHSYDWFPAELGIVFSSWREACKERGSEVLGPRLVCASLFLRLLCPAILAPSLFGLAPDHPAPGPARTLTLIAKVIQNLANRAPFGEKEAYMGFMNSFLEEHGPAMQCFLDQVAMVDVDAAPSGYQGSGDLALQLAVLHAQLCTIFAELDQTTRDTLEPLPTILRAIEEGQPVLVSVPMRLPLPPAQVHSSLSAGEKPGFLAPRDLPKHTPLISKSQSLRSVRRSESWARPRPDEERPLRRPRPVQRTQSVPVRRPARRRQSAGPWPRPKGSLSMGPAPRARPWTRDSASLPRKPSVPWQRQMDQPQDRNQALGTHRPVNKEHRLNEMERTQAQLRDAVQSLQLSPRTRGSWSQPQPLKAPCLNGDTT

SEQ ID NO: 71909 - protein, 228 aa, Homo sapiens
  Payload ID: 14219
  Gene Symbol: RASAL3
  Gene Name: RAS protein activator like 3
  ENSP ID: ENSP00000476634
AELDQTTRDTLEPLPTILRAIEEGQPVLVSVPMRLPLPPAQVHSSLSAGEKPGFLAPRDLPKHTPLISKSQSLRSVRRSESWARPRPDEERPLRRPRPVQRTQSVPVRRPARRRQSAGPWPRPKGSLSMGPAPRARPWTRDSASLPRKPSVPWQRQMDQPQDRNQALGTHRPVNKLAELQCEVAALREEQKVLSRLVESLSTQIRALTEQQEQLRGQLQDLDSRLRAG

SEQ ID NO: 71910 - protein, 489 aa, Homo sapiens
  Payload ID: 14220
  Gene Symbol: RASGRF1
  Gene Name: Ras protein-specific guanine nucleotide-releasing factor 1
  Uniprot ID: Q13972
  ENSP ID: ENSP00000378228
MYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 71911 - protein, 1273 aa, Homo sapiens
  Payload ID: 14220
  Gene Symbol: RASGRF1
  Gene Name: Ras protein-specific guanine nucleotide-releasing factor 1
  Uniprot ID: Q13972
  ENSP ID: ENSP00000405963
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKHYEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKRTREGTREAEMSRSDASLYCDDVDIRFSKTMNSCKVLQIRYASVERLLERLTDLRFLSIDFLNTFLHSYRVFTTAIVVLDKLITIYKKPISAIPARWLRSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 71912 - protein, 1257 aa, Homo sapiens
  Payload ID: 14220
  Gene Symbol: RASGRF1
  Gene Name: Ras protein-specific guanine nucleotide-releasing factor 1
  Uniprot ID: Q13972
  ENSP ID: ENSP00000452781
MQKGIRLNDGHVASLGLLARKDGTRKGYLSKRSSDNTKWQTKWFALLQNLLFYFESDSSSRPSGLYLLEGCVCDRAPSPKPALSAKEPLEKQHYFTVNFSHENQKALELRTEDAKDCDEWVAAIAHASYRTLATEHEALMQKYLHLLQIVETEKTVAKQLRQQIEDGEIEIERLKAEITSLLKDNERIQSTQTVAPNDEDSDIKKIKKVQSFLRGWLCRRKWKTIIQDYIRSPHADSMRKRNQVVFSMLEAEAEYVQQLHILVNNFLRPLRMAASSKKPPITHDDVSSIFLNSETIMFLHQIFYQGLKARISSWPTLVLADLFDILLPMLNIYQEFVRNHQYSLQILAHCKQNRDFDKLLKHYEAKPDCEERTLETFLTYPMFQIPRYILTLHELLAHTPHEHVERNSLDYAKSKLEELSRIMHDEVSETENIRKNLAIERMIIEGCEILLDTSQTFVRQGSLIQVPMSEKGKITRGRLGSLSLKKEGERQCFLFSKHLIICTRGSGGKLHLTKNGVISLIDCTLLEEPESTEEEAKGSGQDIDHLDFKIGVEPKDSPPFTVILVASSRQEKAAWTSDISQCVDNIRCNGLMMNAFEENSKVTVPQMIKSDASLYCDDVDIRFSKTMNSCKVLQIRYASVERLLERLTDLRFLSIDFLNTFLHSYRVFTTAIVVLDKLITIYKKPISAIPARSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 71913 - protein, 1237 aa, Homo sapiens
  Payload ID: 14221
  Gene Symbol: RASGRF2
  Gene Name: Ras protein-specific guanine nucleotide-releasing factor 2
  Uniprot ID: O14827
  ENSP ID: ENSP00000265080
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIDCTLIEEPDASDDDSKGSGQVFGHLDFKIVVEPPDAAAFTVVLLAPSRQEKAAWMSDISQCVDNIRCNGLMTIVFEENSKVTVPHMIKSDARLHKDDTDICFSKTLNSCKVPQIRYASVERLLERLTDLRFLSIDFLNTFLHTYRIFTTAAVVLGKLSDIYKRPFTSIPVRSLELFFATSQNNRGEHLVDGKSPRLCRKFSSPPPLAVSRTSSPVRARKLSLTSPLNSKIGALDLTTSSSPTTTTQSPAASPPPHTGQIPLDLSRGLSSPEQSPGTVEENVDNPRVDLCNKLKRSIQKAVLESAPADRAGVESSPAADTTELSPCRSPSTPRHLRYRQPGGQTADNAHCSVSPASAFAIATAAAGHGSPPGFNNTERTCDKEFIIRRTATNRVLNVLRHWVSKHAQDFELNNELKMNVLNLLEEVLRDPDLLPQERKAAANILRALSQDDQDDIHLKLEDIIQMTDCMKAECFESLSAMELAEQITLLDHVIFRSIPYEEFLGQGWMKLDKNERTPYIMKTSQHFNDMSNLVASQIMNYADVSSRANAIEKWVAVADICRCLHNYNGVLEITSALNRSAIYRLKKTWAKVSKQTKALMDKLQKTVSSEGRFKNLRETLKNCNPPAVPYLGMYLTDLAFIEEGTPNFTEEGLVNFSKMRMISHIIREIRQFQQTSYRIDHQPKVAQYLLDKDLIIDEDTLYELSLKIEPRLPA

SEQ ID NO: 71914 - protein, 1151 aa, Homo sapiens
  Payload ID: 14221
  Gene Symbol: RASGRF2
  Gene Name: Ras protein-specific guanine nucleotide-releasing factor 2
  ENSP ID: ENSP00000421771
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIDCTLIEEPDASDDDSKGSGQVFGHLDFKIVVEPPDAAAFTVVLLAPSRQEKAAWMSDISQCVDNIRCNGLMTIVFEENSKVTVPHMIKSDARLHKDDTDICFSKTLNSCKVPQIRYASVERLLERLTDLRFLSIDFLNTFLHTYRIFTTAAVVLGKLSDIYKRPFTSIPVRSLELFFATSQNNRGEHLVDGKSPRLCRKFSSPPPLAVSRTSSPVRARKLSLTSPLNSKIGALDLTTSSSPTTTTQSPAASPPPHTGQIPLDLSRGLSSPEQSPGTVEENVDNPRVDLCNKLKRSIQKAVLESAPADRAGVESSPAADTTELSPCRSPSTPRHLRYRQPGGQTADNAHCSVSPASAFAIATAAAGHGSPPGFNNTERTCDKEFIIRRTATNRVLNVLRHWVSKHAQDFELNNELKMNVLNLLEEVLRDPDLLPQERKAAANILRALSQDDQDDIHLKLEDIIQMTDCMKAECFESLSAMELAEQITLLDHVIFRSIPYEEFLGQGWMKLDKNERTPYIMKTSQHFNDMSNLVASQIMNYADVSSRANAIEKWVAVADICRCLHNYNGVLEITSALNRSAIYRLKKTWAKVSKQTKALMDKLQKTVSSEGRFKNLRETLKNSSRLNT

SEQ ID NO: 71915 - protein, 1687 aa, Homo sapiens
  Payload ID: 14222
  Gene Symbol: RREB1
  Gene Name: ras responsive element binding protein 1
  Uniprot ID: Q92766
  ENSP ID: ENSP00000305560
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTDSQSDAETAAAAGEVLDLTSRDREQPSEGATELRQVAGDAPVEQATAETASPVHREEHGRGESHEPEEEHGTEESTGDADGAEEDASSNQSLDLDFATKLMDFKLAEGDGEAGAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 71916 - protein, 1476 aa, Homo sapiens
  Payload ID: 14222
  Gene Symbol: RREB1
  Gene Name: ras responsive element binding protein 1
  Uniprot ID: Q92766
  ENSP ID: ENSP00000335574
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTGQKPFPCQKCDAFFSTKSNCERHQLRKHGVTTCSLRRNGLIPQSKESDVGSHDSTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 71917 - protein, 1687 aa, Homo sapiens; identical to SEQ ID NO: 71915
  Payload ID: 14222
  Gene Symbol: RREB1
  Gene Name: ras responsive element binding protein 1
  Uniprot ID: Q92766
  ENSP ID: ENSP00000369265

SEQ ID NO: 71918 - protein, 1742 aa, Homo sapiens
  Payload ID: 14222
  Gene Symbol: RREB1
  Gene Name: ras responsive element binding protein 1
  Uniprot ID: Q92766
  ENSP ID: ENSP00000369270
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTGQKPFPCQKCDAFFSTKSNCERHQLRKHGVTTCSLRRNGLIPQSKESDVGSHDSTDSQSDAETAAAAGEVLDLTSRDREQPSEGATELRQVAGDAPVEQATAETASPVHREEHGRGESHEPEEEHGTEESTGDADGAEEDASSNQSLDLDFATKLMDFKLAEGDGEAGAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 71919 - protein, 778 aa, Homo sapiens
  Payload ID: 14222
  Gene Symbol: RREB1
  Gene Name: ras responsive element binding protein 1
  ENSP ID: ENSP00000419511
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGR

SEQ ID NO: 71920 - protein, 164 aa, Homo sapiens
  Payload ID: 14222
  Gene Symbol: RREB1
  Gene Name: ras responsive element binding protein 1
  ENSP ID: ENSP00000420299
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLK

SEQ ID NO: 71921 - protein, 136 aa, Homo sapiens
  Payload ID: 14222
  Gene Symbol: RREB1
  Gene Name: ras responsive element binding protein 1
  ENSP ID: ENSP00000420519
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTT

SEQ ID NO: 71922 - protein, 4 aa, Homo sapiens
  Payload ID: 14222
  Gene Symbol: RREB1
  Gene Name: ras responsive element binding protein 1
  ENSP ID: ENSP00000420571
MTSS

SEQ ID NO: 71923 - protein, 755 aa, Homo sapiens
  Payload ID: 14222
  Gene Symbol: RREB1
  Gene Name: ras responsive element binding protein 1
  ENSP ID: ENSP00000483108
MEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTDSQSDAETAAAAGEVLDLTSRDREQPSEGATELRQVAGDAPVEQATAETASPVHREEHGRGESHEPEEEHGTEESTGDADGGRGRVEQPEPGPGLRHQAHGLQAGGGRRRGRAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 71924 - protein, 277 aa, Homo sapiens
  Payload ID: 14223
  Gene Symbol: RSU1
  Gene Name: Ras suppressor protein 1
  Uniprot ID: Q15404
  ENSP ID: ENSP00000339521
MSKSLKKLVEESREKNQPEVDMSDRGISNMLDVNGLFTLSHITQLVLSHNKLTMVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYKYLYGRHMQANPEPPKKNNDKSKKISRKPLAAKNR

SEQ ID NO: 71925 - protein, 277 aa, Homo sapiens; identical to SEQ ID NO: 71924
  Payload ID: 14223
  Gene Symbol: RSU1
  Gene Name: Ras suppressor protein 1
  Uniprot ID: Q15404
  ENSP ID: ENSP00000367154

SEQ ID NO: 71926 - protein, 224 aa, Homo sapiens
  Payload ID: 14223
  Gene Symbol: RSU1
  Gene Name: Ras suppressor protein 1
  Uniprot ID: Q15404
  ENSP ID: ENSP00000473588
MVPPNIAELKNLEVLNFFNNQIEELPTQISSLQKLKHLNLGMNRLNTLPRGFGSLPALEVLDLTYNNLSENSLPGNFFYLTTLRALYLSDNDFEILPPDIGKLTKLQILSLRDNDLISLPKEIGELTQLKELHIQGNRLTVLPPELGNLDLTGQKQVFKAENNPWVTPIADQFQLGVSHVFEYIRSETYKYLYGRHMQANPEPPKKNNDKSKKISRKPLAAKNR

SEQ ID NO: 71927 - protein, 281 aa, Homo sapiens
  Payload ID: 14224
  Gene Symbol: RASD1
  Gene Name: RAS, dexamethasone-induced 1
  Uniprot ID: Q9Y272
  ENSP ID: ENSP00000225688
MKLAAMIKKMCPSDSELSIPAKNCYRMVILGSSKVGKTAIVSRFLTGRFEDAYTPTIEDFHRKFYSIRGEVYQLDILDTSGNHPFPAMRRLSILTGDVFILVFSLDNRDSFEEVQRLRQQILDTKSCLKNKTKENVDVPLVICGNKGDRDFYREVDQREIEQLVGDDPQRCAYFEISAKKNSSLDQMFRALFAMAKLPSEMSPDLHRKVSVQYCDVLHKKALRNKKLLRAGSGGGGGDPGDAFGIVAPFARRPSVHSDLMYIREKASAGSQAKDKERCVIS

SEQ ID NO: 71928 - protein, 122 aa, Homo sapiens
  Payload ID: 14224
  Gene Symbol: RASD1
  Gene Name: RAS, dexamethasone-induced 1
  Uniprot ID: Q9Y272
  ENSP ID: ENSP00000463388
MKLAAMIKKMCPSDSELSIPAKNCYRMVILGSSKVGKTAIVSRFLTGRFEDAYTPTIEDFHRKFYSIRGEVYQLDILDTSGNHPFPAMRRLSILTDPRHQVLPQEQNQGERGRAPGHLRQQG

SEQ ID NO: 71929 - protein, 266 aa, Homo sapiens
  Payload ID: 14225
  Gene Symbol: RASD2
  Gene Name: RASD family, member 2
  Uniprot ID: Q96D21
  ENSP ID: ENSP00000216127
MMKTLSSGNCTLSVPAKNSYRMVVLGASRVGKSSIVSRFLNGRFEDQYTPTIEDFHRKVYNIRGDMYQLDILDTSGNHPFPAMRRLSILTGDVFILVFSLDNRESFDEVKRLQKQILEVKSCLKNKTKEAAELPMVICGNKNDHGELCRQVPTTEAELLVSGDENCAYFEVSAKKNTNVDEMFYVLFSMAKLPHEMSPALHRKISVQYGDAFHPRPFCMRRVKEMDAYGMVSPFARRPSVNSDLKYIKAKVLREGQARERDKCTIQ

SEQ ID NO: 71930 - protein, 211 aa, Homo sapiens
  Payload ID: 14226
  Gene Symbol: RASGEF1A
  Gene Name: RasGEF domain family, member 1A
  ENSP ID: ENSP00000363579
  MOD_RES (1)..(1): Any amino acid
XSCRVAGWVAKLKSFSAKIVQLLKEWTEAFPYDFQDEKAMAELKAITHRVTQCDEENGTVKKAIAQMTQSLLLSLAARSQLQELREKLRPPAVDKGPILKTKPPAAQKDILGVCCDPLVLAQQLTHIELDRVSSIYPEDLMQIVSHMDSLDNHRCRGDLTKTYSLEAYDNWFNCLSMLVATEVCRVVKKKHRTRMLEFFIDVARECFNIGN

SEQ ID NO: 71931 - protein, 489 aa, Homo sapiens
  Payload ID: 14226
  Gene Symbol: RASGEF1A
  Gene Name: RasGEF domain family, member 1A
  Uniprot ID: Q8N9B8
  ENSP ID: ENSP00000363583
MFLEPQETMPQTSVVFSSILGPSCSGQVQPGMGERGGGAGGGSGDLIFQDGHLISGSLEALMEHLVPTVDYYPDRTYIFTFLLSSRVFMPPHDLLARVGQICVEQKQQLEAGPEKAKLKSFSAKIVQLLKEWTEAFPYDFQDEKAMAELKAITHRVTQCDEENGTVKKAIAQMTQSLLLSLAARSQLQELREKLRPPAVDKGPILKTKPPAAQKDILGVCCDPLVLAQQLTHIELDRVSSIYPEDLMQIVSHMDSLDNHRCRGDLTKTYSLEAYDNWFNCLSMLVATEVCRVVKKKHRTRMLEFFIDVARECFNIGNFNSMMAIISGMNLSPVARLKKTWSKVKTAKFDVLEHHMDPSSNFCNYRTALQGATQRSQMANSSREKIVIPVFNLFVKDIYFLHKIHTNHLPNGHINFKKFWEISRQIHEFMTWTQVECPFEKDKKIQSYLLTAPIYSEEALFVASFESEGPENHMEKDSWKTLRTTLLNRA

SEQ ID NO: 71932 - protein, 481 aa, Homo sapiens
  Payload ID: 14226
  Gene Symbol: RASGEF1A
  Gene Name: RasGEF domain family, member 1A
  Uniprot ID: Q8N9B8
  ENSP ID: ENSP00000379154
MPQTSVVFSSILGPSCSGQVQPGMGERGGGAGGGSGDLIFQDGHLISGSLEALMEHLVPTVDYYPDRTYIFTFLLSSRVFMPPHDLLARVGQICVEQKQQLEAGPEKAKLKSFSAKIVQLLKEWTEAFPYDFQDEKAMAELKAITHRVTQCDEENGTVKKAIAQMTQSLLLSLAARSQLQELREKLRPPAVDKGPILKTKPPAAQKDILGVCCDPLVLAQQLTHIELDRVSSIYPEDLMQIVSHMDSLDNHRCRGDLTKTYSLEAYDNWFNCLSMLVATEVCRVVKKKHRTRMLEFFIDVARECFNIGNFNSMMAIISGMNLSPVARLKKTWSKVKTAKFDVLEHHMDPSSNFCNYRTALQGATQRSQMANSSREKIVIPVFNLFVKDIYFLHKIHTNHLPNGHINFKKFWEISRQIHEFMTWTQVECPFEKDKKIQSYLLTAPIYSEEALFVASFESEGPENHMEKDSWKTLRTTLLNRA

SEQ ID NO: 71933 - protein, 481 aa, Homo sapiens; identical to SEQ ID NO: 71932
  Payload ID: 14226
  Gene Symbol: RASGEF1A
  Gene Name: RasGEF domain family, member 1A
  Uniprot ID: Q8N9B8
  ENSP ID: ENSP00000379155

SEQ ID NO: 71934 - protein, 473 aa, Homo sapiens
  Payload ID: 14227
  Gene Symbol: RASGEF1B
  Gene Name: RasGEF domain family, member 1B
  Uniprot ID: Q0VAM2
  ENSP ID: ENSP00000264400
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEQTYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 71935 - protein, 431 aa, Homo sapiens
  Payload ID: 14227
  Gene Symbol: RASGEF1B
  Gene Name: RasGEF domain family, member 1B
  Uniprot ID: Q0VAM2
  ENSP ID: ENSP00000338437
MPQTPPFSAMFDSSGYNRNLYQSAEDSCGGLYYHDNNLLSGSLEALIQHLVPNVDYYPDNQMRKIAPKILQLLTEWTETFPYDFRDERMMRNLKDLAHRIASGEETYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 71936 - protein, 210 aa, Homo sapiens
  Payload ID: 14227
  Gene Symbol: RASGEF1B
  Gene Name: RasGEF domain family, member 1B
  ENSP ID: ENSP00000398763
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEVGNLNLARLLEFPGRAWVGNGAELCILISTASSLFCLWASPPHHILVYLVCQVRMIIPSHFKGI

SEQ ID NO: 71937 - protein, 472 aa, Homo sapiens
  Payload ID: 14227
  Gene Symbol: RASGEF1B
  Gene Name: RasGEF domain family, member 1B
  Uniprot ID: Q0VAM2
  ENSP ID: ENSP00000425393
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEETYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 71938 - protein, 232 aa, Homo sapiens
  Payload ID: 14227
  Gene Symbol: RASGEF1B
  Gene Name: RasGEF domain family, member 1B
  ENSP ID: ENSP00000426929
MMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEG

SEQ ID NO: 71939 - protein, 10 aa, Homo sapiens
  Payload ID: 14227
  Gene Symbol: RASGEF1B
  Gene Name: RasGEF domain family, member 1B
  ENSP ID: ENSP00000476065
MPQTPPFSAM

SEQ ID NO: 71940 - protein, 210 aa, Homo sapiens; identical to SEQ ID NO: 71936
  Payload ID: 14227
  Gene Symbol: RASGEF1B
  Gene Name: RasGEF domain family, member 1B
  ENSP ID: ENSP00000484927

SEQ ID NO: 71941 - protein, 466 aa, Homo sapiens
  Payload ID: 14228
  Gene Symbol: RASGEF1C
  Gene Name: RasGEF domain family, member 1C
  Uniprot ID: Q8N431
  ENSP ID: ENSP00000354963
MPQTLSASDMVTPGSLSPPPTEPTDGEQAGQPLLDGAPSSASLETLIQHLVPTADYYPEKAYIFTFLLSSRLFIEPRELLARVCHLCIEQQQLDKPVLDKARVRKFGPKLLQLLAEWTETFPRDFQEESTIGHLKDVVGRIAPCDEAYRKRMHQLLQALHQKLAALRQGPEGLVGADKPISYRTKPPASIHRELLGVCSDPYTLAQQLTHVELERLRHIGPEEFVQAFVNKDPLASTKPCFSDKTSNLEAYVKWFNRLCYLVATEICMPAKKKQRAQVIEFFIDVARECFNIGNFNSLMAIISGMNMSPVSRLKKTWAKVRTAKFFILEHQMDPTGNFCNYRTALRGAAHRSLTAHSSREKIVIPFFSLLIKDIYFLNEGCANRLPNGHVNFEKFLELAKQVGEFITWKQVECPFEQDASITHYLYTAPIFSEDGLYLASYESESPENQTEKERWKALRSSILGKT

SEQ ID NO: 71942 - protein, 466 aa, Homo sapiens; identical to SEQ ID NO: 71941
  Payload ID: 14228
  Gene Symbol: RASGEF1C
  Gene Name: RasGEF domain family, member 1C
  Uniprot ID: Q8N431
  ENSP ID: ENSP00000377037

SEQ ID NO: 71943 - protein, 315 aa, Homo sapiens
  Payload ID: 14228
  Gene Symbol: RASGEF1C
  Gene Name: RasGEF domain family, member 1C
  Uniprot ID: Q8N431
  ENSP ID: ENSP00000429114
MHQLLQALHQKLAALRQGPEGLVGADKPISYRTKPPASIHRELLGVCSDPYTLAQQLTHVELERLRHIGPEEFVQAFVNKDPLASTKPCFSDKTSNLEAYVKWFNRLCYLVATEICMPAKKKQRAQVIEFFIDVARECFNIGNFNSLMAIISGMNMSPVSRLKKTWAKVRTAKFFILEHQMDPTGNFCNYRTALRGAAHRSLTAHSSREKIVIPFFSLLIKDIYFLNEGCANRLPNGHVNFEKFLELAKQVGEFITWKQVECPFEQDASITHYLYTAPIFSEDGLYLASYESESPENQTEKERWKALRSSILGKT

SEQ ID NO: 71944 - protein, 238 aa, Homo sapiens
  Payload ID: 14228
  Gene Symbol: RASGEF1C
  Gene Name: RasGEF domain family, member 1C
  ENSP ID: ENSP00000430659
MHQLLQALHQKLAALRQGPEGLVGADKPISYRTKPPASIHRELLGVCSDPYTLAQQLTHVELERLRHIGPEEFVQAFVNKDPLASTKPCFSDKTSNLEAYVKWFNRLCYLVATEICMPAKKKQRAQVIEFFIDVARECFNIGNFNSLMAIISGMNMSPVSRLKKTWAKVRTAKFFILEHQMDPTGNFCNYRTALRGAAHRSLTAHSSREKEATLGGRGEQITRLSFLSSACSSKTSTS

SEQ ID NO: 71945 - protein, 238 aa, Homo sapiens; identical to SEQ ID NO: 71944
  Payload ID: 14228
  Gene Symbol: RASGEF1C
  Gene Name: RasGEF domain family, member 1C
  ENSP ID: ENSP00000481349

SEQ ID NO: 71946 - protein, 236 aa, Homo sapiens
  Payload ID: 14229
  Gene Symbol: RIT1
  Gene Name: Ras-like without CAAX 1
  Uniprot ID: Q92963
  ENSP ID: ENSP00000357305
MERWLFLGATEEGPKRTMDSGTRPVGSCCSSPAGLSREYKLVMLGAGGVGKSAMTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 71947 - protein, 219 aa, Homo sapiens
  Payload ID: 14229
  Gene Symbol: RIT1
  Gene Name: Ras-like without CAAX 1
  Uniprot ID: Q92963
  ENSP ID: ENSP00000357306
MDSGTRPVGSCCSSPAGLSREYKLVMLGAGGVGKSAMTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 71948 - protein, 183 aa, Homo sapiens
  Payload ID: 14229
  Gene Symbol: RIT1
  Gene Name: Ras-like without CAAX 1
  Uniprot ID: Q92963
  ENSP ID: ENSP00000441950
MTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 71949 - protein, 92 aa, Homo sapiens
  Payload ID: 14229
  Gene Symbol: RIT1
  Gene Name: Ras-like without CAAX 1
  ENSP ID: ENSP00000476319
MDSGTRPVGSCCSSPAGLSREYKLVMLGAGGVGKSAMTMQFISHRFPEDHDPTIEDAYKIRIRIDDEPANLDILDTAGQDSRQSLQPCGTSI

SEQ ID NO: 71950 - protein, 151 aa, Homo sapiens
  Payload ID: 14229
  Gene Symbol: RIT1
  Gene Name: Ras-like without CAAX 1
  ENSP ID: ENSP00000476612
MDSGTRPVGSCCSSPAGLSREYKLVMLGAGGVGKSAMTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLA

SEQ ID NO: 71951 - protein, 217 aa, Homo sapiens
  Payload ID: 14230
  Gene Symbol: RIT2
  Gene Name: Ras-like without CAAX 2
  Uniprot ID: Q99578
  ENSP ID: ENSP00000321805
MEVENEASCSPGSASGGSREYKVVMLGAGGVGKSAMTMQFISHQFPDYHDPTIEDAYKTQVRIDNEPAYLDILDTAGQAEFTAMREQYMRGGEGFIICYSVTDRQSFQEAAKFKELIFQVRHTYEIPLVLVGNKIDLEQFRQVSTEEGLSLAQEYNCGFFETSAALRFCIDDAFHGLVREIRKKESMPSLMEKKLKRKDSLWKKLKGSLKKKRENMT

SEQ ID NO: 71952 - protein, 169 aa, Homo sapiens
  Payload ID: 14230
  Gene Symbol: RIT2
  Gene Name: Ras-like without CAAX 2
  ENSP ID: ENSP00000466620
MEVENEASCSPGSASGGSREYKVVMLGAGGVGKSAMTMQFISHQFPDYHDPTIEDAYKTQVRIDNEPAYLDILDTAGQLCDWLKHRWEVELWEIRRTEKQNSQPCGSSTCEVGKASSSATPSLTVNHFRRLPSLKSSFFRSATPMKFPWCWWVTKLIWNSSARFLQKKA

SEQ ID NO: 71953 - protein, 153 aa, Homo sapiens
  Payload ID: 14230
  Gene Symbol: RIT2
  Gene Name: Ras-like without CAAX 2
  Uniprot ID: Q99578
  ENSP ID: ENSP00000467217
MEVENEASCSPGSASGGSREYKVVMLGAGGVGKSAMTMQFISHQFPDYHDPTIEDAYKTQVRIDNEPAYLDILDTAGQAEFTAMREQYMRGGEGFIICYSVTDRQSFQEAAKFKELIFQVRHTYEIPLVLVGNKIDLEQFRQPTLKEFGREEF

SEQ ID NO: 71954 - protein, 199 aa, Homo sapiens
  Payload ID: 14231
  Gene Symbol: RERG
  Gene Name: RAS-like, estrogen-regulated, growth inhibitor
  Uniprot ID: Q96A58
  ENSP ID: ENSP00000256953
MAKSAEVKLAIFGRAGVGKSALVVRFLTKRFIWEYDPTLESTYRHQATIDDEVVSMEILDTAGQEDTIQREGHMRWGEGFVLVYDITDRGSFEEVLPLKNILDEIKKPKNVTLILVGNKADLDHSRQVSTEEGEKLATELACAFYECSACTGEGNITEIFYELCREVRRRRMVQGKTRRRSSTTHVKQAINKMLTKISS

SEQ ID NO: 71955 - protein, 199 aa, Homo sapiens; identical to SEQ ID NO: 71954
  Payload ID: 14231
  Gene Symbol: RERG
  Gene Name: RAS-like, estrogen-regulated, growth inhibitor
  Uniprot ID: Q96A58
  ENSP ID: ENSP00000438280

SEQ ID NO: 71956 - protein, 113 aa, Homo sapiens
  Payload ID: 14231
  Gene Symbol: RERG
  Gene Name: RAS-like, estrogen-regulated, growth inhibitor
  ENSP ID: ENSP00000439532
MIRYILQRRRMIHLRNWIVLKERKSITEKGNFKALVVRFLTKRFIWEYDPTLESTYRHQATIDDEVVSMEILDTAGQEDTIQREGHMRWGEGFVLVYDITDRGSFEEVLPLKN

SEQ ID NO: 71957 - protein, 38 aa, Homo sapiens
  Payload ID: 14231
  Gene Symbol: RERG
  Gene Name: RAS-like, estrogen-regulated, growth inhibitor
  ENSP ID: ENSP00000440887
MAKSAEVKLAIFGRAGVGKSALVVRFLTKRFIWEYDPT

SEQ ID NO: 71958 - protein, 199 aa, Homo sapiens; identical to SEQ ID NO: 71954
  Payload ID: 14231
  Gene Symbol: RERG
  Gene Name: RAS-like, estrogen-regulated, growth inhibitor
  Uniprot ID: Q96A58
  ENSP ID: ENSP00000441505

SEQ ID NO: 71959 - protein, 70 aa, Homo sapiens
  Payload ID: 14231
  Gene Symbol: RERG
  Gene Name: RAS-like, estrogen-regulated, growth inhibitor
  ENSP ID: ENSP00000441860
MAKSAEVKLAIFGRAGVGKSALVVRFLTKRFIWEYDPTLESTYRHQATIDDEVVSMEILDTAGQVNKEFS

SEQ ID NO: 71960 - protein, 180 aa, Homo sapiens
  Payload ID: 14231
  Gene Symbol: RERG
  Gene Name: RAS-like, estrogen-regulated, growth inhibitor
  Uniprot ID: Q96A58
  ENSP ID: ENSP00000444485
MAKSAEVKLAIFGRAGVGKSESTYRHQATIDDEVVSMEILDTAGQEDTIQREGHMRWGEGFVLVYDITDRGSFEEVLPLKNILDEIKKPKNVTLILVGNKADLDHSRQVSTEEGEKLATELACAFYECSACTGEGNITEIFYELCREVRRRRMVQGKTRRRSSTTHVKQAINKMLTKISS

SEQ ID NO: 71961 - protein, 203 aa, Homo sapiens
  Payload ID: 14232
  Gene Symbol: RASL10A
  Gene Name: RAS-like, family 10, member A
  Uniprot ID: Q92737
  ENSP ID: ENSP00000216101
MGGSLRVAVLGAPGVGKTAIIRQFLFGDYPERHRPTDGPRLYRPAVLLDGAVYDLSIRDGDVAGPGSSPGGPEEWPDAKDWSLQDTDAFVLVYDICSPDSFDYVKALRQRIAETRPAGAPEAPILVVGNKRDRQRLRFGPRRALAALVRRGWRCGYLECSAKYNWHVLRLFRELLRCALVRARPAHPALRLQGALHPARCSLM

SEQ ID NO: 71962 - protein, 115 aa, Homo sapiens
  Payload ID: 14232
  Gene Symbol: RASL10A
  Gene Name: RAS-like, family 10, member A
  Uniprot ID: Q92737
  ENSP ID: ENSP00000386095
MGGSLRVAVLGAPGVGKTAIIRQFLFGDYPERHRPTDGPRLYRPAVLLDGAVYDLSIRDGDVAGPGSSPGGPEEWPDAKDWSLQDTDAFVLVYDICSPDSFDYVKALRQRIAETR

SEQ ID NO: 71963 - protein, 203 aa, Homo sapiens
  Payload ID: 14233
  Gene Symbol: RASL10B
  Gene Name: RAS-like, family 10, member B
  Uniprot ID: Q96S79
  ENSP ID: ENSP00000474230
MVSTYRVAVLGARGVGKSAIVRQFLYNEFSEVCVPTTARRLYLPAVVMNGHVHDLQILDFPPISAFPVNTLQEWADTCCRGLRSVHAYILVYDICCFDSFEYVKTIRQQILETRVIGTSETPIIIVGNKRDLQRGRVIPRWNVSHLVRKTWKCGYVECSAKYNWHILLLFSELLKSVGCARCKHVHAALRFQGALRRNRCAIM

SEQ ID NO: 71964 - protein, 242 aa, Homo sapiens
  Payload ID: 14234
  Gene Symbol: RASL11A
  Gene Name: RAS-like, family 11, member A
  Uniprot ID: Q6T310
  ENSP ID: ENSP00000241463
MRPLSMSGHFLLAPIPESSSDYLLPKDIKLAVLGAGRVGKSAMIVRFLTKRFIGDYEPNTGKLYSRLVYVEGDQLSLQIQDTPGGVQIQDSLPQVVDSLSKCVQWAEGFLLVYSITDYDSYLSIRPLYQHIRKVHPDSKAPVIIVGNKGDLLHARQVQTQDGIQLANELGSLFLEISTSENYEDVCDVFQHLCKEVSKMHGLSGERRRASIIPRPRSPNMQDLKRRFKQALSPKVKAPSALG

SEQ ID NO: 71965 - protein, 248 aa, Homo sapiens
  Payload ID: 14235
  Gene Symbol: RASL11B
  Gene Name: RAS-like, family 11, member B
  Uniprot ID: Q9BPW5
  ENSP ID: ENSP00000248706
MRLIQNMCTIAEYPAPGNAAASDCCVGAAGRRLVKIAVVGASGVGKTALVVRFLTKRFIGDYERNAGNLYTRQVQIEGETLALQVQDTPGIQVHENSLSCSEQLNRCIRWADAVVIVFSITDYKSYELISQLHQHVQQLHLGTRLPVVVVANKADLLHIKQVDPQLGLQLASMLGCSFYEVSVSENYNDVYSAFHVLCKEVSHKQQPSSTPEKRRTSLIPRPKSPNMQDLKRRFKQALSAKVRTVTSV

SEQ ID NO: 71966 - protein, 266 aa, Homo sapiens
  Payload ID: 14236
  Gene Symbol: RASL12
  Gene Name: RAS-like, family 12
  Uniprot ID: Q9NYN1
  ENSP ID: ENSP00000220062
MSSVFGKPRAGSGPQSAPLEVNLAILGRRGAGKSALTVKFLTKRFISEYDPNLEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 71967 - protein, 247 aa, Homo sapiens
  Payload ID: 14236
  Gene Symbol: RASL12
  Gene Name: RAS-like, family 12
  Uniprot ID: Q9NYN1
  ENSP ID: ENSP00000390028
MSSVFGKPRAGSGPQSAPLEVNLAILGRRGAGKSEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 71968 - protein, 255 aa, Homo sapiens
  Payload ID: 14236
  Gene Symbol: RASL12
  Gene Name: RAS-like, family 12
  Uniprot ID: Q9NYN1
  ENSP ID: ENSP00000412787
MVIMGPELVGSWSDFKNEAADPRALTVKFLTKRFISEYDPNLEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 71969 - protein, 308 aa, Homo sapiens
  Payload ID: 14237
  Gene Symbol: RRAD
  Gene Name: Ras-related associated with diabetes
  Uniprot ID: P55042
  ENSP ID: ENSP00000299759
MTLNGGGSGAGGSRGGGQERERRRGSTPWGPAPPLHRRSMPVDERDLQAALTPGALTAAAAGTGTQGPRLDWPEDSEDSLSSGGSDSDESVYKVLLLGAPGVGKSALARIFGGVEDGPEAEAAGHTYDRSIVVDGEEASLMVYDIWEQDGGRWLPGHCMAMGDAYVIVYSVTDKGSFEKASELRVQLRRARQTDDVPIILVGNKSDLVRSREVSVDEGRACAVVFDCKFIETSAALHHNVQALFEGVVRQIRLRRDSKEANARRQAGTRRRESLGKKAKRFLGRIVARNSRKMAFRAKSKSCHDLSVL

SEQ ID NO: 71970 - protein, 308 aa, Homo sapiens; identical to SEQ ID NO: 71969
  Payload ID: 14237
  Gene Symbol: RRAD
  Gene Name: Ras-related associated with diabetes
  Uniprot ID: P55042
  ENSP ID: ENSP00000388744

SEQ ID NO: 71971 - protein, 136 aa, Homo sapiens
  Payload ID: 14237
  Gene Symbol: RRAD
  Gene Name: Ras-related associated with diabetes
  ENSP ID: ENSP00000461995
  MOD_RES (1)..(1): Any amino acid
XLDWPEDSEDSLSSGGSDSDESVYKVLLLGAPGVGKSALARIFGGVEDGPEAEAAGHTYDRSIVVDGEEASLMVYDIWEQCCPAKWLSGASEGWAHRDACAGSYASQAAAAQPPGRPACRERTLPFFTARVCLPWR

SEQ ID NO: 71972 - protein, 162 aa, Homo sapiens
  Payload ID: 14237
  Gene Symbol: RRAD
  Gene Name: Ras-related associated with diabetes
  ENSP ID: ENSP00000462559
  MOD_RES (1)..(1): Any amino acid
XEDSLSSGGSDSDESVYKVLLLGAPGVGKSALARIFGGVEDGPEAEAAGHTYDRSIVVDGEEASLMVYDIWEQDGGRWLPGHCMAMGDAYVIVYSVTDKGSFEKASELRAQTLGPSELPAGHPQPHGHGQIDSAALRSGSQGPVRAGPTEMHAQAHMRPKQP

SEQ ID NO: 71973 - protein, 192 aa, Homo sapiens
  Payload ID: 14238
  Gene Symbol: RAC1
  Gene Name: ras-related C3 botulinum toxin substrate 1 (rho family, small GTP binding protein Rac1)
  Uniprot ID: P63000
  ENSP ID: ENSP00000258737
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 71974 - protein, 211 aa, Homo sapiens
  Payload ID: 14238
  Gene Symbol: RAC1
  Gene Name: ras-related C3 botulinum toxin substrate 1 (rho family, small GTP binding protein Rac1)
  Uniprot ID: P63000
  ENSP ID: ENSP00000348461
MQAIKCVVVGDGAVGKTCLLISYTTNAFPGEYIPTVFDNYSANVMVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 71975 - protein, 192 aa, Homo sapiens
  Payload ID: 14239
  Gene Symbol: RAC2
  Gene Name: ras-related C3 botulinum toxin substrate 2 (rho family, small GTP binding protein Rac2)
  Uniprot ID: P15153
  ENSP ID: ENSP00000249071
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 71976 - protein, 148 aa, Homo sapiens
  Payload ID: 14239
  Gene Symbol: RAC2
  Gene Name: ras-related C3 botulinum toxin substrate 2 (rho family, small GTP binding protein Rac2)
  ENSP ID: ENSP00000385270
MVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 71977 - protein, 185 aa, Homo sapiens
  Payload ID: 14239
  Gene Symbol: RAC2
  Gene Name: ras-related C3 botulinum toxin substrate 2 (rho family, small GTP binding protein Rac2)
  ENSP ID: ENSP00000385590
MQAIKAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 71978 - protein, 86 aa, Homo sapiens
  Payload ID: 14239
  Gene Symbol: RAC2
  Gene Name: ras-related C3 botulinum toxin substrate 2 (rho family, small GTP binding protein Rac2)
  ENSP ID: ENSP00000385666
MQAIKCVVVGDGAVGKTCLLISYTTNAFPGEYIPTVPGRPCALLQDAEAGLSSDVEGACWCQTQEGRMTGEAPAPPWPALRGPHHS

SEQ ID NO: 71979 - protein, 166 aa, Homo sapiens
  Payload ID: 14239
  Gene Symbol: RAC2
  Gene Name: ras-related C3 botulinum toxin substrate 2 (rho family, small GTP binding protein Rac2)
  ENSP ID: ENSP00000403778
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLK

SEQ ID NO: 71980 - protein, 192 aa, Homo sapiens
  Payload ID: 14240
  Gene Symbol: RAC3
  Gene Name: ras-related C3 botulinum toxin substrate 3 (rho family, small GTP binding protein Rac3)
  Uniprot ID: P60763
  ENSP ID: ENSP00000304283
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPHTPILLVGTKLDLRDDKDTIERLRDKKLAPITYPQGLAMAREIGSVKYLECSALTQRGLKTVFDEAIRAVLCPPPVKKPGKKCTVF

SEQ ID NO: 71981 - protein, 130 aa, Homo sapiens
  Payload ID: 14240
  Gene Symbol: RAC3
  Gene Name: ras-related C3 botulinum toxin substrate 3 (rho family, small GTP binding protein Rac3)
  ENSP ID: ENSP00000462421
MVDGKPVNLGLWDTAGQEDYDRLRPLSYPQTDVFLICFSLVSPASFENVRAKWYPEVRHHCPHTPILLVGTKLDLRDDKDTIERLRDKKLAPITYPQGLAMAREIGSVKYLECSALTQRGLKTVFDEAIR

SEQ ID NO: 71982 - protein, 136 aa, Homo sapiens
  Payload ID: 14240
  Gene Symbol: RAC3
  Gene Name: ras-related C3 botulinum toxin substrate 3 (rho family, small GTP binding protein Rac3)
  ENSP ID: ENSP00000463590
MVDGKPVNLGLWDTAGQEDYDRLRPLSYPQTDVFLICFSLVSPASFENVRAKWYPEVRHHCPHTPILLVGTKLDLRDDKDTIERLRDKKLAPITYPQGLAMAREIGSVKYLECSALTQRGLKTVFDEAIRAVLCPP

SEQ ID NO: 71983 - protein, 313 aa, Homo sapiens
  Payload ID: 14241
  Gene Symbol: RRAGA
  Gene Name: Ras-related GTP binding A
  Uniprot ID: Q7L523
  ENSP ID: ENSP00000369899
MPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECACFRTSIWDETLYKAWSSIVYQLIPNVQQLEMNLRNFAQIIEADEVLLFERATFLVISHYQCKEQRDVHRFEKISNIIKQFKLSCSKLAASFQSMEVRNSNFAAFIDIFTSNTYVMVVMSDPSIPSAATLINIRNARKHFEKLERVDGPKHSLLMR

SEQ ID NO: 71984 - protein, 374 aa, Homo sapiens
  Payload ID: 14242
  Gene Symbol: RRAGB
  Gene Name: Ras-related GTP binding B
  Uniprot ID: Q5VZM2
  ENSP ID: ENSP00000262850
MEESDSEKTTEKENLGPRMDPPLGEPEGSLGWVLPNTAMKKKVLLMGKSGSGKTSMRSIIFANYIARDTRRLGATILDRIHSLQINSSLSTYSLVDSVGNTKTFDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIEADEVLLFERATFLVISHYQCKEQRDAHRFEKISNIIKQFKLSCSKLAASFQSMEVRNSNFAAFIDIFTSNTYVMVVMSDPSIPSAATLINIRNARKHFEKLERVDGPKQCLLMR

SEQ ID NO: 71985 - protein, 346 aa, Homo sapiens
  Payload ID: 14242
  Gene Symbol: RRAGB
  Gene Name: Ras-related GTP binding B
  Uniprot ID: Q5VZM2
  ENSP ID: ENSP00000364077
MEESDSEKTTEKENLGPRMDPPLGEPEGSLGWVLPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIEADEVLLFERATFLVISHYQCKEQRDAHRFEKISNIIKQFKLSCSKLAASFQSMEVRNSNFAAFIDIFTSNTYVMVVMSDPSIPSAATLINIRNARKHFEKLERVDGPKQCLLMR

SEQ ID NO: 71986 - protein, 194 aa, Homo sapiens
  Payload ID: 14242
  Gene Symbol: RRAGB
  Gene Name: Ras-related GTP binding B
  ENSP ID: ENSP00000410630
MKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIE

SEQ ID NO: 71987 - protein, 399 aa, Homo sapiens
  Payload ID: 14243
  Gene Symbol: RRAGC
  Gene Name: Ras-related GTP binding C
  Uniprot ID: Q9HB90
  ENSP ID: ENSP00000362092
MSLQYGAEETPLAGSYGAADSFPKDFGYGVEEEEEEAAAAGGGVGAGAGGGCGPGGADSSKPRILLMGLRRSGKSSIQKVVFHKMSPNETLFLESTNKIYKDDISNSSFVNFQIWDFPGQMDFFDPTFDYEMIFRGTGALIYVIDAQDDYMEALTRLHITVSKAYKVNPDMNFEVFIHKVDGLSDDHKIETQRDIHQRANDDLADAGLEKLHLSFYLTSIYDHSIFEAFSKVVQKLIPQLPTLENLLNIFISNSGIEKAFLFDVVSKIYIATDSSPVDMQSYELCCDMIDVVIDVSCIYGLKEDGSGSAYDKESMAIIKLNNTTVLYLKEVTKFLALVCILREESFERKGLIDYNFHCFRKAIHEVFEVGVTSHRSCGHQTSASSLKALTHNGTPRNAI

SEQ ID NO: 71988 - protein, 249 aa, Homo sapiens
  Payload ID: 14244
  Gene Symbol: RRAGD
  Gene Name: Ras-related GTP binding D
  Uniprot ID: Q9NQL2
  ENSP ID: ENSP00000352131
MEALARLHLTVTRAYKVNTDINFEVFIHKVDGLSDDHKIETQRDIHQRANDDLADAGLEKIHLSFYLTSIYDHSIFEAFSKVVQKLIPQLPTLENLLNIFISNSGIEKAFLFDVVSKIYIATDSTPVDMQTYELCCDMIDVVIDISCIYGLKEDGAGTPYDKESTAIIKLNNTTVLYLKEVTKFLALVCFVREESFERKGLIDYNFHCFRKAIHEVFEVRMKVVKSRKVQNRLQKKKRATPNGTPRVLL

SEQ ID NO: 71989 - protein, 400 aa, Homo sapiens
  Payload ID: 14244
  Gene Symbol: RRAGD
  Gene Name: Ras-related GTP binding D
  Uniprot ID: Q9NQL2
  ENSP ID: ENSP00000358423
MSQVLGKPQPQDEDDAEEEEEEDELVGLADYGDGPDSSDADPDSGTEEGVLDFSDPFSTEVKPRILLMGLRRSGKSSIQKVVFHKMSPNETLFLESTNKICREDVSNSSFVNFQIWDFPGQIDFFDPTFDYEMIFRGTGALIFVIDSQDDYMEALARLHLTVTRAYKVNTDINFEVFIHKVDGLSDDHKIETQRDIHQRANDDLADAGLEKIHLSFYLTSIYDHSIFEAFSKVVQKLIPQLPTLENLLNIFISNSGIEKAFLFDVVSKIYIATDSTPVDMQTYELCCDMIDVVIDISCIYGLKEDGAGTPYDKESTAIIKLNNTTVLYLKEVTKFLALVCFVREESFERKGLIDYNFHCFRKAIHEVFEVRMKVVKSRKVQNRLQKKKRATPNGTPRVLL

SEQ ID NO: 71990 - protein, 165 aa, Homo sapiens
  Payload ID: 14245
  Gene Symbol:
  Gene Name: Ras-related protein Rap-1b-like protein  [Source:UniProtKB/Swiss-Prot
  Acc:A6NIZ1]
  ENSP ID: ENSP00000488326
MREYKLVVLGSRGVGKSALTVQFVQGIFVEKYDPTIEDSYRTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 71991 - protein, 184 aa, Homo sapiens
  Payload ID: 14245
  Gene Symbol:
  Gene Name: Ras-related protein Rap-1b-like protein  [Source:UniProtKB/Swiss-Prot
  Acc:A6NIZ1]
  Uniprot ID: A6NIZ1
  ENSP ID: ENSP00000488821
MREYKLVVLGSRGVGKSALTVQFVQGIFVEKYDPTIEDSYREQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 71992 - protein, 1594 aa, Homo sapiens
  Payload ID: 14246
  Gene Symbol: RB1CC1
  Gene Name: RB1-inducible coiled-coil 1
  Uniprot ID: Q8TDY2
  ENSP ID: ENSP00000025008
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAEMKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPGEGASGASRRPWVLGKVMEKEYCQAKKAQNRFKVPLGTKFYRVKAVSWNKKV

SEQ ID NO: 71993 - protein, 1591 aa, Homo sapiens
  Payload ID: 14246
  Gene Symbol: RB1CC1
  Gene Name: RB1-inducible coiled-coil 1
  Uniprot ID: Q8TDY2
  ENSP ID: ENSP00000396067
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAEMKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPASGASRRPWVLGKVMEKEYCQAKKAQNRFKVPLGTKFYRVKAVSWNKKV

SEQ ID NO: 71994 - protein, 42 aa, Homo sapiens
  Payload ID: 14246
  Gene Symbol: RB1CC1
  Gene Name: RB1-inducible coiled-coil 1
  ENSP ID: ENSP00000429115
MVPGVAGSAAAAGEGGGVAGFLSLTSNAIQLPISSKANISQF

SEQ ID NO: 71995 - protein, 15 aa, Homo sapiens
  Payload ID: 14246
  Gene Symbol: RB1CC1
  Gene Name: RB1-inducible coiled-coil 1
  ENSP ID: ENSP00000429611
MKLYVFLVNTGTTLT

SEQ ID NO: 71996 - protein, 52 aa, Homo sapiens
  Payload ID: 14246
  Gene Symbol: RB1CC1
  Gene Name: RB1-inducible coiled-coil 1
  ENSP ID: ENSP00000429879
MAADRRVCTYSAGTDTNPIFLFNKEMILCDRPPAIPKTTFSTENDMEIKVEE

SEQ ID NO: 71997 - protein, 72 aa, Homo sapiens
  Payload ID: 14246
  Gene Symbol: RB1CC1
  Gene Name: RB1-inducible coiled-coil 1
  ENSP ID: ENSP00000429918
MVPGVAGSAAAAGEGGGVAGVADLKHAIQSKYKIAIQHQVLVVNGGECMAADRRVCTYSAGTDTNPIFLFNK

SEQ ID NO: 71998 - protein, 109 aa, Homo sapiens
  Payload ID: 14246
  Gene Symbol: RB1CC1
  Gene Name: RB1-inducible coiled-coil 1
  ENSP ID: ENSP00000430792
  MOD_RES (1)..(1): Any amino acid
XQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFNSKASKV

SEQ ID NO: 71999 - protein, 127 aa, Homo sapiens
  Payload ID: 14246
  Gene Symbol: RB1CC1
  Gene Name: RB1-inducible coiled-coil 1
  ENSP ID: ENSP00000430809
  MOD_RES (1)..(1): Any amino acid
XIMLLERTLQLKEEENKRLNQRLMSQSMSSVSSRHSEKIAIRDFQVGDLVLIILDERHDNYVLFTVSPTLYFLHSESLPALDLKPASGASRRPWVLGKVMEKEYCQAKKCSFITPKTAGHLFMQKSA

SEQ ID NO: 72000 - protein, 113 aa, Homo sapiens
  Payload ID: 14247
  Gene Symbol: RBAK-RBAKDN
  Gene Name: RBAK-RBAKDN readthrough
  ENSP ID: ENSP00000380112
MNTLQGPVSFKDVAVDFTQEEWQQLDPDEKITYRDVMLENYSHLVSVGYDTTKPNVIIKLEQGEEPWIMGGEFPCQHSPAALPAGHVAPAVAAAAAAPGRPGPHRQSRSPPGC

SEQ ID NO: 72001 - protein, 243 aa, Homo sapiens
  Payload ID: 14247
  Gene Symbol: RBAK-RBAKDN
  Gene Name: RBAK-RBAKDN readthrough
  ENSP ID: ENSP00000385560
MNTLQGPVSFKDVAVDFTQEEWQQLDPDEKITYRDVMLENYSHLVSVGYDTTKPNVIIKLEQGEEPWIMGGEFPCQHSPEAWRVDDLIERIQENEDKHSSRPARRPCGPRCCCCCCCSRPPRSPPPKPLPTRMLTPRKAFRTCSKESGLAETESCGQTHTWPRALAVLMGLWWPRDQKAGEEDLRFRERRPGLQATATGSGEHGAFPVHSQGVWASTHWQGTAVCPLQTPPPDAFIRNNKVLS

SEQ ID NO: 72002 - protein, 714 aa, Homo sapiens
  Payload ID: 14248
  Gene Symbol: RBAK
  Gene Name: RB-associated KRAB zinc finger
  Uniprot ID: Q9NYW8
  ENSP ID: ENSP00000275423
MNTLQGPVSFKDVAVDFTQEEWQQLDPDEKITYRDVMLENYSHLVSVGYDTTKPNVIIKLEQGEEPWIMGGEFPCQHSPEAWRVDDLIERIQENEDKHSRQAACINSKTLTEEKENTFSQIYMETSLVPSSIIAHNCVSCGKNLESISQLISSDGSYARTKPDECNECGKTYHGEKMCEFNQNGDTYSHNEENILQKISILEKPFEYNECMEALDNEAVFIAHKRAYIGEKPYEWNDSGPDFIQMSNFNAYQRSQMEMKPFECSECGKSFCKKSKFIIHQRAHTGEKPYECNVCGKSFSQKGTLTVHRRSHLEEKPYKCNECGKTFCQKLHLTQHLRTHSGEKPYECSECGKTFCQKTHLTLHQRNHSGERPYPCNECGKSFSRKSALSDHQRTHTGEKLYKCNECGKSYYRKSTLITHQRTHTGEKPYQCSECGKFFSRVSYLTIHYRSHLEEKPYECNECGKTFNLNSAFIRHRKVHTEEKSHECSECGKFSQLYLTDHHTAHLEEKPYECNECGKTFLVNSAFDGHQPLPKGEKSYECNVCGKLFNELSYYTEHYRSHSEEKPYGCSECGKTFSHNSSLFRHQRVHTGEKPYECYECGKFFSQKSYLTIHHRIHSGEKPYECSKCGKVFSRMSNLTVHYRSHSGEKPYECNECGKVFSQKSYLTVHYRTHSGEKPYECNECGKKFHHRSAFNSHQRIHRRGNMNVLDVENL

SEQ ID NO: 72003 - protein, 714 aa, Homo sapiens; identical to SEQ ID NO: 72002
  Payload ID: 14248
  Gene Symbol: RBAK
  Gene Name: RB-associated KRAB zinc finger
  Uniprot ID: Q9NYW8
  ENSP ID: ENSP00000380120

SEQ ID NO: 72004 - protein, 664 aa, Homo sapiens
  Payload ID: 14249
  Gene Symbol: RBBP8NL
  Gene Name: RBBP8 N-terminal like
  Uniprot ID: Q8NC74
  ENSP ID: ENSP00000252998
MESFMESLNRLKEIHEKEVLGLQNKLLELNSERCRDAQRIEELFSKNHQLREQQKTLKENLRVLENRLRAGLCDRCMVTQELARKRQQEFESSHLQNLQRIFILTNEMNGLKEENETLKEEVKRLRGLGDRPKPRAKEGTSDPPSPLLLPSPGGWKAITEKPPGGHEEAEEDHQGVGLRGEEKPAGHRTSPVAKISPGATLPESRAPDMSPQRISNQLHGTIAVVRPGSQACPADRGPANGTPPPLPARSSPPSPAYERGLSLDSFLRASRPSAMTHEAPKLSPKVDRLCLLNRPLSLHLQSPHSSPLAPAAAPSDPRLQDLKAREAEAWEEPTELLGLPSALAGMQDLRLEGALHLLLAQQQLRARARAGSVRPRGQPTPGEMLPSLPVGSDSEGPENEGTRAALAAAGLSGGRHTQPAGPGRAQRTEAAATQDCALDKPLDLSEWGRARGQDTPKPAGQHGSLSPAAAHTASPEPPTQSGPLTRSPQALSNGTKGTRVPEQEEASTPMDPSRPLPGSQLSLSSPGSTEDEDTGRPLPPPHPQPPPHPQPPDLDGHPEPSKAEVLRPESDELDETDTPGSEVGLSSQAEATTSTTGEGPECICTQEHGQGPPRKRKRASEPGDKASKKPSRGRRKLTATEGPGSPRDAEDHSPSPNSSPWEET

SEQ ID NO: 72005 - protein, 339 aa, Homo sapiens
  Payload ID: 14250
  Gene Symbol: RBM14-RBM4
  Gene Name: RBM14-RBM4 readthrough
  ENSP ID: ENSP00000388552
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGKRMHVQLSTSRLRTAPGMGDQSGCYRCGKEGHWSKECPIDRSGRVADLTEQYNEQYGAVRTPYTMSYGDSLYYNNAYGALDAYYKRCRAARSYEAVAAAAASVYNYAEQTLSQLPQVQNTAMASHLTSTSLDPYDRHLLPTSGAAATAAAAAAAAAAVTAASTSYYGRDRSPLRRATAPVPTVGEGYGYGHESELSQASAAARNSLYDMARYEREQYADRARYSAF

SEQ ID NO: 72006 - protein, 147 aa, Homo sapiens
  Payload ID: 14250
  Gene Symbol: RBM14-RBM4
  Gene Name: RBM14-RBM4 readthrough
  ENSP ID: ENSP00000395880
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGSCQDGEAVHRKPAPGGYRAGDSLTLRAVWEGAGM

SEQ ID NO: 72007 - protein, 118 aa, Homo sapiens
  Payload ID: 14250
  Gene Symbol: RBM14-RBM4
  Gene Name: RBM14-RBM4 readthrough
  ENSP ID: ENSP00000421279
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKGGMCVG

SEQ ID NO: 72008 - protein, 269 aa, Homo sapiens
  Payload ID: 14251
  Gene Symbol: RITA1
  Gene Name: RBPJ interacting and tubulin associated 1
  Uniprot ID: Q96K30
  ENSP ID: ENSP00000448289
MKTPVELAVSGMQTLGLQHRCRGGYRVKARTSYVDETLFGSPAGTRPTPPDFDPPWVEKANRTRGVGKEASKALGAKGSCETTPSRGSTPTLTPRKKNKYRPISHTPSYCDESLFGSRSEGASFGAPRMAKGDAAKLRALLWTPPPTPRGSHSPRPREAPLRAIHPAGPSKTEPGPAADSQKLSMGGLHSSRPLKRGLSHSLTHLNVPSTGHPATSAPHTNGPQDLRPSTSGVTFRSPLVTSRARSVSISVPSTPRRGGATQKPKPPWK

SEQ ID NO: 72009 - protein, 293 aa, Homo sapiens
  Payload ID: 14251
  Gene Symbol: RITA1
  Gene Name: RBPJ interacting and tubulin associated 1
  Uniprot ID: Q96K30
  ENSP ID: ENSP00000448680
MLREPRKQGLAGRAHLLSPGTTGSMKTPVELAVSGMQTLGLQHRCRGGYRVKARTSYVDETLFGSPAGTRPTPPDFDPPWVEKANRTRGVGKEASKALGAKGSCETTPSRGSTPTLTPRKKNKYRPISHTPSYCDESLFGSRSEGASFGAPRMAKGDAAKLRALLWTPPPTPRGSHSPRPREAPLRAIHPAGPSKTEPGPAADSQKLSMGGLHSSRPLKRGLSHSLTHLNVPSTGHPATSAPHTNGPQDLRPSTSGVTFRSPLVTSRARSVSISVPSTPRRGGATQKPKPPWK

SEQ ID NO: 72010 - protein, 269 aa, Homo sapiens; identical to SEQ ID NO: 72008
  Payload ID: 14251
  Gene Symbol: RITA1
  Gene Name: RBPJ interacting and tubulin associated 1
  Uniprot ID: Q96K30
  ENSP ID: ENSP00000449841

SEQ ID NO: 72011 - protein, 38 aa, Homo sapiens
  Payload ID: 14251
  Gene Symbol: RITA1
  Gene Name: RBPJ interacting and tubulin associated 1
  ENSP ID: ENSP00000484184
RGVGKEASKALGAKGSCETTPSRGSTPTLTPRKKNKYR

SEQ ID NO: 72012 - protein, 115 aa, Homo sapiens
  Payload ID: 14252
  Gene Symbol: RCAN3
  Gene Name: RCAN family member 3
  Uniprot ID: Q9UKA8
  ENSP ID: ENSP00000363514
MLRDTMKSWNDSQSDLCSTDQEEEEEMIFGENEDDLDEMMDLSDLPTSLFACSVHEAVFEAREQKERNMNFTREQSRHPAWWFMSVKVKLKRKKRQKTPNRKLPRRGAPTLRPQR

SEQ ID NO: 72013 - protein, 241 aa, Homo sapiens
  Payload ID: 14252
  Gene Symbol: RCAN3
  Gene Name: RCAN family member 3
  Uniprot ID: Q9UKA8
  ENSP ID: ENSP00000363516
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQVQMSGEVRDKSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 72014 - protein, 173 aa, Homo sapiens
  Payload ID: 14252
  Gene Symbol: RCAN3
  Gene Name: RCAN family member 3
  Uniprot ID: Q9UKA8
  ENSP ID: ENSP00000391912
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQERNMNFTREQSRHPAWWFMSVKVKLKRKKRQKTPNRKLPRRGAPTLRPQR

SEQ ID NO: 72015 - protein, 231 aa, Homo sapiens
  Payload ID: 14252
  Gene Symbol: RCAN3
  Gene Name: RCAN family member 3
  Uniprot ID: Q9UKA8
  ENSP ID: ENSP00000409540
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 72016 - protein, 183 aa, Homo sapiens
  Payload ID: 14252
  Gene Symbol: RCAN3
  Gene Name: RCAN family member 3
  Uniprot ID: Q9UKA8
  ENSP ID: ENSP00000414447
MLRDTMKSWNDSQSDLCSTDQEEEEEMIFGENEDDLDEMMDLSDLPTSLFACSVHEAVFEAREQKVQMSGEVRDKSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 72017 - protein, 108 aa, Homo sapiens
  Payload ID: 14252
  Gene Symbol: RCAN3
  Gene Name: RCAN family member 3
  ENSP ID: ENSP00000437338
  MOD_RES (1)..(1): Any amino acid
XYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 72018 - protein, 241 aa, Homo sapiens; identical to SEQ ID NO: 72013
  Payload ID: 14252
  Gene Symbol: RCAN3
  Gene Name: RCAN family member 3
  Uniprot ID: Q9UKA8
  ENSP ID: ENSP00000445401

SEQ ID NO: 72019 - protein, 116 aa, Homo sapiens
  Payload ID: 14252
  Gene Symbol: RCAN3
  Gene Name: RCAN family member 3
  Uniprot ID: Q9UKA8
  ENSP ID: ENSP00000478174
MSGEVRDKSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 72020 - protein, 241 aa, Homo sapiens; identical to SEQ ID NO: 72013
  Payload ID: 14252
  Gene Symbol: RCAN3
  Gene Name: RCAN family member 3
  Uniprot ID: Q9UKA8
  ENSP ID: ENSP00000479300

SEQ ID NO: 72021 - protein, 116 aa, Homo sapiens; identical to SEQ ID NO: 72019
  Payload ID: 14252
  Gene Symbol: RCAN3
  Gene Name: RCAN family member 3
  Uniprot ID: Q9UKA8
  ENSP ID: ENSP00000484519

SEQ ID NO: 72022 - protein, 183 aa, Homo sapiens; identical to SEQ ID NO: 72016
  Payload ID: 14252
  Gene Symbol: RCAN3
  Gene Name: RCAN family member 3
  Uniprot ID: Q9UKA8
  ENSP ID: ENSP00000486836

SEQ ID NO: 72023 - protein, 376 aa, Homo sapiens
  Payload ID: 14253
  Gene Symbol: RCCD1
  Gene Name: RCC1 domain containing 1
  Uniprot ID: A6NED2
  ENSP ID: ENSP00000377801
MAEERPGAWFGFGFCGFGQELGSGRGRQVHSPSPLRAGVDICRVSASWSYTAFVTRGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATELNEDGSQVKRTGGAEDGAPAPFIAVQPFPALLDLPMGSDAVKASCGSRHTAVVTRTGELYTWGWGKYGQLGHEDTTSLDRPRRVEYFVDKQLQVKAVTCGPWNTYVYAVEKGKS

SEQ ID NO: 72024 - protein, 374 aa, Homo sapiens
  Payload ID: 14253
  Gene Symbol: RCCD1
  Gene Name: RCC1 domain containing 1
  ENSP ID: ENSP00000450678
MAEERPGAWFGFGFCGFGQELGSGRGRQVHSPSPLRAGVDICRVSASWSYTAFVTRGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREELNEDGSQVKRTGGAEDGAPAPFIAVQPFPALLDLPMGSDAVKASCGSRHTAVVTRTGELYTWGWGKYGQLGHEDTTSLDRPRRVEYFVDKQLQVKAVTCGPWNTYVYAVEKGKS

SEQ ID NO: 72025 - protein, 78 aa, Homo sapiens
  Payload ID: 14253
  Gene Symbol: RCCD1
  Gene Name: RCC1 domain containing 1
  ENSP ID: ENSP00000451365
  MOD_RES (1)..(1): Any amino acid
XEERPGAWFGFGFCGFGQELGSGRGRQVHSPSPLRAGVDICRVSASWSYTAFVTRMDSWAMGPWRQSWSHGCWRRCRA

SEQ ID NO: 72026 - protein, 376 aa, Homo sapiens; identical to SEQ ID NO: 72023
  Payload ID: 14253
  Gene Symbol: RCCD1
  Gene Name: RCC1 domain containing 1
  Uniprot ID: A6NED2
  ENSP ID: ENSP00000451963

SEQ ID NO: 72027 - protein, 299 aa, Homo sapiens
  Payload ID: 14254
  Gene Symbol: RQCD1
  Gene Name: RCD1 required for cell differentiation1 homolog (S. pombe)
  Uniprot ID: Q92600
  ENSP ID: ENSP00000273064
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 72028 - protein, 258 aa, Homo sapiens
  Payload ID: 14254
  Gene Symbol: RQCD1
  Gene Name: RCD1 required for cell differentiation1 homolog (S. pombe)
  Uniprot ID: Q92600
  ENSP ID: ENSP00000295701
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRFSDLTFCWSSFQRK

SEQ ID NO: 72029 - protein, 75 aa, Homo sapiens
  Payload ID: 14254
  Gene Symbol: RQCD1
  Gene Name: RCD1 required for cell differentiation1 homolog (S. pombe)
  ENSP ID: ENSP00000392394
MHSLATAAPVPTTLAQVDREKIYQWINELSSPETRENALLELSKKRESVPDLAPMLWHSFGTIAALLQVIVMQVI

SEQ ID NO: 72030 - protein, 61 aa, Homo sapiens
  Payload ID: 14254
  Gene Symbol: RQCD1
  Gene Name: RCD1 required for cell differentiation1 homolog (S. pombe)
  ENSP ID: ENSP00000396938
ILQKILLDDTGLAYICQTYERFSHVAMILGKMVLQLSKEPSARLLKHVVRCYLRLSDNPRC

SEQ ID NO: 72031 - protein, 41 aa, Homo sapiens
  Payload ID: 14254
  Gene Symbol: RQCD1
  Gene Name: RCD1 required for cell differentiation1 homolog (S. pombe)
  ENSP ID: ENSP00000415607
MHSLATAADLALLPRLECSGVILAHRNLDLLGSVDSPTSAS

SEQ ID NO: 72032 - protein, 299 aa, Homo sapiens; identical to SEQ ID NO: 72027
  Payload ID: 14254
  Gene Symbol: RQCD1
  Gene Name: RCD1 required for cell differentiation1 homolog (S. pombe)
  Uniprot ID: Q92600
  ENSP ID: ENSP00000443687

SEQ ID NO: 72033 - protein, 331 aa, Homo sapiens
  Payload ID: 14254
  Gene Symbol: RQCD1
  Gene Name: RCD1 required for cell differentiation1 homolog (S. pombe)
  Uniprot ID: Q92600
  ENSP ID: ENSP00000486540
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIVETGFHHVGQADLELPTSSDLPASASQSAGITGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 72034 - protein, 197 aa, Homo sapiens
  Payload ID: 14255
  Gene Symbol: RCSD1
  Gene Name: RCSD domain containing 1
  ENSP ID: ENSP00000355291
MEERPAETNANVDNSASPSVAQLAGRFREQAAAAKETPASKPTRRKPPCSLPLFPPKVDLGQNGEEANLTFDPAALLPGASPKSPGLKAMVSPFHSPPSTPSSPGVRSRPSEAEEVPVSFDQPPEGSHLPCYNKVRTRGSIKRRPPSRRFRRSQSDCGELGDFRAVESSQQNGAKEEDGDEVLPSKSKAPGSPLSSE

SEQ ID NO: 72035 - protein, 416 aa, Homo sapiens
  Payload ID: 14255
  Gene Symbol: RCSD1
  Gene Name: RCSD domain containing 1
  Uniprot ID: Q6JBY9
  ENSP ID: ENSP00000356828
MEERPAETNANVDNSASPSVAQLAGRFREQAAAAKETPASKPTRRKPPCSLPLFPPKVDLGQNGEEKSPPNASHPPKFKVKSSPLIEKLQANLTFDPAALLPGASPKSPGLKAMVSPFHSPPSTPSSPGVRSRPSEAEEVPVSFDQPPEGSHLPCYNKVRTRGSIKRRPPSRRFRRSQSDCGELGDFRAVESSQQNGAKEEDGDEVLPSKSKAPGSPLSSEGAAGEGVRTLGPAEKPPLRRSPSRTEKQEEDRATEEAKNGEKARRSSEEVDGQHPAQEEVPESPQTSGPEAENRCGSPREEKPAGEEAEMEKATEVKGERVQNEEVGPEHDSQETKKLEEGAAVKETPHSPPGGVKGGDVPKQEKGKEKQQEGAVLEPGCSPQTGPAQLETSSEVQSEPAVPKPEDDTPVQDTKM

SEQ ID NO: 72036 - protein, 386 aa, Homo sapiens
  Payload ID: 14255
  Gene Symbol: RCSD1
  Gene Name: RCSD domain containing 1
  ENSP ID: ENSP00000439409
MEERPAETNANVDNSASPSVAQLAGRFREQAAAAKEKSPPNASHPPKFKVKSSPLIEKLQANLTFDPAALLPGASPKSPGLKAMVSPFHSPPSTPSSPGVRSRPSEAEEVPVSFDQPPEGSHLPCYNKVRTRGSIKRRPPSRRFRRSQSDCGELGDFRAVESSQQNGAKEEDGDEVLPSKSKAPGSPLSSEGAAGEGVRTLGPAEKPPLRRSPSRTEKQEEDRATEEAKNGEKARRSSEEVDGQHPAQEEVPESPQTSGPEAENRCGSPREEKPAGEEAEMEKATEVKGERVQNEEVGPEHDSQETKKLEEGAAVKETPHSPPGGVKGGDVPKQEKGKEKQQEGAVLEPGCSPQTGPAQLETSSEVQSEPAVPKPEDDTPVQDTKM

SEQ ID NO: 72037 - protein, 1097 aa, Homo sapiens
  Payload ID: 14256
  Gene Symbol: REST
  Gene Name: RE1-silencing transcription factor
  Uniprot ID: Q13127
  ENSP ID: ENSP00000311816
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 72038 - protein, 340 aa, Homo sapiens
  Payload ID: 14256
  Gene Symbol: REST
  Gene Name: RE1-silencing transcription factor
  ENSP ID: ENSP00000479151
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSVGYGYHLVIFTRV

SEQ ID NO: 72039 - protein, 314 aa, Homo sapiens
  Payload ID: 14256
  Gene Symbol: REST
  Gene Name: RE1-silencing transcription factor
  ENSP ID: ENSP00000481650
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 72040 - protein, 340 aa, Homo sapiens; identical to SEQ ID NO: 72038
  Payload ID: 14256
  Gene Symbol: REST
  Gene Name: RE1-silencing transcription factor
  ENSP ID: ENSP00000484058

SEQ ID NO: 72041 - protein, 342 aa, Homo sapiens
  Payload ID: 14256
  Gene Symbol: REST
  Gene Name: RE1-silencing transcription factor
  ENSP ID: ENSP00000484206
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSEMEFRSCCPGWNKMV

SEQ ID NO: 72042 - protein, 1097 aa, Homo sapiens; identical to SEQ ID NO: 72037
  Payload ID: 14256
  Gene Symbol: REST
  Gene Name: RE1-silencing transcription factor
  Uniprot ID: Q13127
  ENSP ID: ENSP00000484836

SEQ ID NO: 72043 - protein, 79 aa, Homo sapiens
  Payload ID: 14257
  Gene Symbol: ROMO1
  Gene Name: reactive oxygen species modulator 1
  Uniprot ID: P60602
  ENSP ID: ENSP00000338293
MPVAVGPYGQSQPSCFDRVKMGFVMGCAVGMAAGALFGTFSCLRIGMRGRELMGGIGKTMMQSGGTFGTFMAIGMGIRC

SEQ ID NO: 72044 - protein, 59 aa, Homo sapiens
  Payload ID: 14257
  Gene Symbol: ROMO1
  Gene Name: reactive oxygen species modulator 1
  Uniprot ID: P60602
  ENSP ID: ENSP00000363185
MPVAVGPYGQSQPSCFDRVKMGFVMGCAVGMAAGALFGTFSCLSSILVSSSGSECGVES

SEQ ID NO: 72045 - protein, 79 aa, Homo sapiens; identical to SEQ ID NO: 72043
  Payload ID: 14257
  Gene Symbol: ROMO1
  Gene Name: reactive oxygen species modulator 1
  Uniprot ID: P60602
  ENSP ID: ENSP00000363190

SEQ ID NO: 72046 - protein, 79 aa, Homo sapiens; identical to SEQ ID NO: 72043
  Payload ID: 14257
  Gene Symbol: ROMO1
  Gene Name: reactive oxygen species modulator 1
  Uniprot ID: P60602
  ENSP ID: ENSP00000363191

SEQ ID NO: 72047 - protein, 79 aa, Homo sapiens; identical to SEQ ID NO: 72043
  Payload ID: 14257
  Gene Symbol: ROMO1
  Gene Name: reactive oxygen species modulator 1
  Uniprot ID: P60602
  ENSP ID: ENSP00000380561

SEQ ID NO: 72048 - protein, 1914 aa, Homo sapiens
  Payload ID: 14258
  Gene Symbol: RLF
  Gene Name: rearranged L-myc fusion
  Uniprot ID: Q13129
  ENSP ID: ENSP00000361857
MADGKGDAAAVAGAGAEAPAVAGAGDGVETESMVRGHRPVSPAPGASGLRPCLWQLETELREQEVSEVSSLNYCRSFCQTLLQYASNKNASEHIVYLLEVYRLAIQSFASARPYLTTECEDVLLVLGRLVLSCFELLLSVSESELPCEVWLPFLQSLQESHDALLEFGNNNLQILVHVTKEGVWKNPVLLKILSQQPVETEEVNKLIAQEGPSFLQMRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYDEGKEDKQYRRRDLTDQHKEKRDKKPIGSSERYQRWLQYKFFCLLCKRECIEARILHHSKMHMEDGIYTCPVCIKKFKRKEMFVPHVMEHVKMPPSRRDRSKKKLLLKGSQKGICPKSPSAIPEQNHSLNDQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHEAQHFRDASYTCNFLGCKKFYYSKIEYQNHLSMHNVENSNGDIKKSVKLEESATGEKQDCINQPHLLNQTDKSHLPEDLFCAESANSQIDTETAENLKENSDSNSSDQLSHSSSASMNEELIDTLDHSETMQDVLLSNEKVFGPSSLKEKCSSMAVCFDGTKFTCGFDGCGSTYKNARGMQKHLRKVHPYHFKPKKIKTKDLFPSLGNEHNQTTEKLDAEPKPCSDTNSDSPDEGLDHNIHIKCKREHQGYSSESSICASKRPCTEDTMLELLLRLKHLSLKNSITHGSFSGSLQGYPSSGAKSLQSVSSISDLNFQNQDENMPSQYLAQLAAKPFFCELQGCKYEFVTREALLMHYLKKHNYSKEKVLQLTMFQHRYSPFQCHICQRSFTRKTHLRIHYKNKHQIGSDRATHKLLDNEKCDHEGPCSVDRLKGDCSAELGGDPSSNSEKPHCHPKKDECSSETDLESSCEETESKTSDISSPIGSHREEQEGREGRGSRRTVAKGNLCYILNKYHKPFHCIHKTCNSSFTNLKGLIRHYRTVHQYNKEQLCLEKDKARTKRELVKCKKIFACKYKECNKRFLCSKALAKHCSDSHNLDHIEEPKVLSEAGSAARFSCNQPQCPAVFYTFNKLKHHLMEQHNIEGEIHSDYEIHCDLNGCGQIFTHRSNYSQHVYYRHKDYYDDLFRSQKVANERLLRSEKVCQTADTQGHEHQTTRRSFNAKSKKCGLIKEKKAPISFKTRAEALHMCVEHSEHTQYPCMVQGCLSVVKLESSIVRHYKRTHQMSSAYLEQQMENLVVCVKYGTKIKEEPPSEADPCIKKEENRSCESERTEHSHSPGDSSAPIQNTDCCHSSERDGGQKGCIESSSVFDADTLLYRGTLKCNHSSKTTSLEQCNIVQPPPPCKIENSIPNPNGTESGTYFTSFQLPLPRIKESETRQHSSGQENTVKNPTHVPKENFRKHSQPRSFDLKTYKPMGFESSFLKFIQESEEKEDDFDDWEPSEHLTLSNSSQSSNDLTGNVVANNMVNDSEPEVDIPHSSSDSTIHENLTAIPPLIVAETTTVPSLENLRVVLDKALTDCGELALKQLHYLRPVVVLERSKFSTPILDLFPTKKTDELCVGSS

SEQ ID NO: 72049 - protein, 266 aa, Homo sapiens
  Payload ID: 14259
  Gene Symbol: REC114
  Gene Name: REC114 meiotic recombination protein
  Uniprot ID: Q7Z4M0
  ENSP ID: ENSP00000328423
MAEAGKVPLSLGLTGGEAAEWPLQRYARCIPSNTRDPPGPCLEAGTAPCPTWKVFDSNEESGYLVLTIVISGHFFIFQGQTLLEGFSLIGSKDWLKIVRRVDCLLFGTTIKDKSRLFRVQFSGESKEQALEHCCSCVQKLAQYITVQVPDGNIQELQLIPGPPRATESQGKDSAKSVPRQPGSHQHSEQQQVCVTAGTGAPDGRTSLTQLAQTLLASEELPHVYEQSAWGAEELGPFLRLCLMDQNFPAFVEEVEKELKKLAGLRN

SEQ ID NO: 72050 - protein, 238 aa, Homo sapiens
  Payload ID: 14259
  Gene Symbol: REC114
  Gene Name: REC114 meiotic recombination protein
  ENSP ID: ENSP00000452908
MAEAGKVPLSLGLTGGEAAEWPLQRYARCIPSNTRDPPGPCLEAGTAPCPTWKVFDSNEESGYLVLTIVISGHFFIFQGQTLLDKSRLFRVQFSGESKEQALEHCCSCVQKLAQYITVQVPDGNIQELQLIPGPPRATESQGKDSAKSVPRQPGSHQHSEQQQVCVTAGTGAPDGRTSLTQLAQTLLASEELPHVYEQSAWGAEELGPFLRLCLMDQNFPAFVEEVEKELKKLAGLRN

SEQ ID NO: 72051 - protein, 336 aa, Homo sapiens
  Payload ID: 14260
  Gene Symbol: REC8
  Gene Name: REC8 meiotic recombination protein
  ENSP ID: ENSP00000452701
  MOD_RES (1)..(1): Any amino acid
XRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLGECMHVCVCMWGRDTETRGPYRDSPDLPSPRLLTSALSATDSSRETRKAIWSPPDPAGAQIPLRLESIYKAARKPATSSKPRRASLGPAYLISECAFPAFLLSELLFKQKTSCFYY

SEQ ID NO: 72052 - protein, 93 aa, Homo sapiens
  Payload ID: 14260
  Gene Symbol: REC8
  Gene Name: REC8 meiotic recombination protein
  ENSP ID: ENSP00000453506
METELPSLLLPNHLAMMETLEDAPDPFFGMMSVDPRLPSPFDIPQIRHLLEAAIPERVEEIPPEVPTEPREPERIPVTVLPPEAITILEAEPI

SEQ ID NO: 72053 - protein, 74 aa, Homo sapiens
  Payload ID: 14260
  Gene Symbol: REC8
  Gene Name: REC8 meiotic recombination protein
  ENSP ID: ENSP00000453763
MFYYPNVLQRHTGCFATIWLAATRGSRLVKREYLRVNVVKTCEEILNYVLVRVQPPQPGLPRPRFSLYLSAQLQ

SEQ ID NO: 72054 - protein, 547 aa, Homo sapiens
  Payload ID: 14260
  Gene Symbol: REC8
  Gene Name: REC8 meiotic recombination protein
  Uniprot ID: O95072
  ENSP ID: ENSP00000482439
MFYYPNVLQRHTGCFATIWLAATRGSRLVKREYLRVNVVKTCEEILNYVLVRVQPPQPGLPRPRFSLYLSAQLQIGVIRVYSQQCQYLVEDIQHILERLHRAQLQIRIDMETELPSLLLPNHLAMMETLEDAPDPFFGMMSVDPRLPSPFDIPQIRHLLEAAIPERVEEIPPEVPTEPREPERIPVTVLPPEAITILEAEPIRMLEIEGERELPEVSRRELDLLIAEEEEAILLEIPRLPPPAPAEVEGIGEALGPEELRLTGWEPGALLMEVTPPEELRLPAPPSPERRPPVPPPPRRRRRRRLLFWDKETQISPEKFQEQLQTRAHCWECPMVQPPERTIRGPAELFRTPTLSGWLPPELLGLWTHCAQPPPKALRRELPEEAAAEEERRKIEVPSEIEVPREALEPSVPLMVSLEISLEAAEEEKSRISLIPPEERWAWPEVEAPEAPALPVVPELPEVPMEMPLVLPPELELLSLEAVHRAVALELQANREPDFSSLVSPLSPRRMAARVFYLLLVLSAQQILHVKQEKPYGRLLIQPGPRFH

SEQ ID NO: 72055 - protein, 547 aa, Homo sapiens; identical to SEQ ID NO: 72054
  Payload ID: 14260
  Gene Symbol: REC8
  Gene Name: REC8 meiotic recombination protein
  Uniprot ID: O95072
  ENSP ID: ENSP00000482546

SEQ ID NO: 72056 - protein, 263 aa, Homo sapiens
  Payload ID: 14261
  Gene Symbol: RTP1
  Gene Name: receptor (chemosensory) transporter protein 1
  Uniprot ID: P59025
  ENSP ID: ENSP00000311712
MRIFRPWRLRCPALHLPSLSVFSLRWKLPSLTTDETMCKSVTTDEWKKVFYEKMEEAKPADSWDLIIDPNLKHNVLSPGWKQYLELHASGRFHCSWCWHTWQSPYVVILFHMFLDRAQRAGSVRMRVFKQLCYECGTARLDESSMLEENIEGLVDNLITSLREQCYGERGGQYRIHVASRQDNRRHRGEFCEACQEGIVHWKPSEKLLEEEATTYTFSRAPSPTKSQDQTGSGWNFCSIPWCLFWATVLLLIIYLQFSFRSSV

SEQ ID NO: 72057 - protein, 225 aa, Homo sapiens
  Payload ID: 14262
  Gene Symbol: RTP2
  Gene Name: receptor (chemosensory) transporter protein 2
  Uniprot ID: Q5QGT7
  ENSP ID: ENSP00000350976
MCTSLTTCEWKKVFYEKMEVAKPADSWELIIDPNLKPSELAPGWKQYLEQHASGRFHCSWCWHTWQSAHVVILFHMFLDRAQRAGSVRMRVFKQLCYECGTARLDESSMLEENIEGLVDNLITSLREQCYEEDGGQYRIHVASRPDSGPHRAEFCEACQEGIVHWKPSEKLLEEEVTTYTSEASKPRAQAGSGYNFLSLRWCLFWASLCLLVVYLQFSFLSPAFF

SEQ ID NO: 72058 - protein, 232 aa, Homo sapiens
  Payload ID: 14263
  Gene Symbol: RTP3
  Gene Name: receptor (chemosensory) transporter protein 3
  Uniprot ID: Q9BQQ7
  ENSP ID: ENSP00000296142
MAGDTEVWKQMFQELMREVKPWHRWTLRPDKGLLPNVLKPGWMQYQQWTFARFQCSSCSRNWASAQVLVLFHMNWSEEKSRGQVKMRVFTQRCKKCPQPLFEDPEFTQENISRILKNLVFRILKKCYRGRFQLIEEVPMIKDISLEGPHNSDNCEACLQGFCAGPIQVTSLPPSQTPRVHSIYKVEEVVKPWASGENVYSYACQNHICRNLSIFCCCVILIVIVVIVVKTAI

SEQ ID NO: 72059 - protein, 246 aa, Homo sapiens
  Payload ID: 14264
  Gene Symbol: RTP4
  Gene Name: receptor (chemosensory) transporter protein 4
  Uniprot ID: Q96DX8
  ENSP ID: ENSP00000259030
MVVDFWTWEQTFQELIQEAKPRATWTLKLDGNLQLDCLAQGWKQYQQRAFGWFRCSSCQRSWASAQVQILCHTYWEHWTSQGQVRMRLFGQRCQKCSWSQYEMPEFSSDSTMRILSNLVQHILKKYYGNGTRKSPEMPVILEVSLEGSHDTANCEACTLGICGQGLKSCMTKPSKSLLPHLKTGNSSPGIGAVYLANQAKNQSAEAKEAKGSGYEKLGPSRDPDPLNICVFILLLVFIVVKCFTSE

SEQ ID NO: 72060 - protein, 572 aa, Homo sapiens
  Payload ID: 14265
  Gene Symbol: RTP5
  Gene Name: receptor (chemosensory) transporter protein 5 (putative)
  Uniprot ID: Q14D33
  ENSP ID: ENSP00000345374
MDRAGADMWASTFTLAMAERKPQDVWVLLPEHSLVPGCLDGGGVQYLLVGLSRLQCGHCPGTWDSAHVHVLFHLWWDRASHRGLVKMRIWGQRCRLCPAPGDCQVRPPGEQPFLSRLVLHILQDCYGDGPGPARHPREAYEGCCEACELGVCFLQKAPDPAWSANATKGNFPATAWGGTGTVSRGKPLSTPGDDLGKGGVVIAIPFSLVGTSNDQVPIAEGPAPPAGASLPVTGSCEALVIGQGSIFLSGDSVAMPGGKGFPVAIGDPLFHGPGLLGSSIQTFELKGFLFKGRGSLCSPVGVAQGWGPISLNNGLVPVGKHTPTVFYCVGLSASGEGSLTFPSSLTSIFTNTLSEPTDGPVATKEASITFPFIFTDVKDAVAEVAEGNGKEGGGQGLVPVGHDALPETNAGGLPSQVKGSLALPFPADVQGKDAFTDITEGKEKEGGLVTAGHDAPLEANAEGPITVSEGCITIPFAVFDVIKRKGGGHVAYGPQGNGCFSQGYYQKRQLRSRFHKARCGCRREEDERPGRACRRPHAEPYEDFWIWVSMTVCVFWLMCMCRLNPGIYPQQV

SEQ ID NO: 72061 - protein, 55 aa, Homo sapiens
  Payload ID: 14265
  Gene Symbol: RTP5
  Gene Name: receptor (chemosensory) transporter protein 5 (putative)
  ENSP ID: ENSP00000397191
MDRAGADMWASTFTLAMAERKPQDVWVLLPEHSLVPGCLDGGGVQYLLVGLSRVP

SEQ ID NO: 72062 - protein, 572 aa, Homo sapiens; identical to SEQ ID NO: 72060
  Payload ID: 14265
  Gene Symbol: RTP5
  Gene Name: receptor (chemosensory) transporter protein 5 (putative)
  Uniprot ID: Q14D33
  ENSP ID: ENSP00000482049

SEQ ID NO: 72063 - protein, 55 aa, Homo sapiens; identical to SEQ ID NO: 72061
  Payload ID: 14265
  Gene Symbol: RTP5
  Gene Name: receptor (chemosensory) transporter protein 5 (putative)
  ENSP ID: ENSP00000486266

SEQ ID NO: 72064 - protein, 148 aa, Homo sapiens
  Payload ID: 14266
  Gene Symbol: RAMP1
  Gene Name: receptor (G protein-coupled) activity modifying protein 1
  Uniprot ID: O60894
  ENSP ID: ENSP00000254661
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 72065 - protein, 126 aa, Homo sapiens
  Payload ID: 14266
  Gene Symbol: RAMP1
  Gene Name: receptor (G protein-coupled) activity modifying protein 1
  ENSP ID: ENSP00000384688
MTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 72066 - protein, 126 aa, Homo sapiens; identical to SEQ ID NO: 72065
  Payload ID: 14266
  Gene Symbol: RAMP1
  Gene Name: receptor (G protein-coupled) activity modifying protein 1
  ENSP ID: ENSP00000386046

SEQ ID NO: 72067 - protein, 126 aa, Homo sapiens; identical to SEQ ID NO: 72065
  Payload ID: 14266
  Gene Symbol: RAMP1
  Gene Name: receptor (G protein-coupled) activity modifying protein 1
  ENSP ID: ENSP00000386720

SEQ ID NO: 72068 - protein, 175 aa, Homo sapiens
  Payload ID: 14267
  Gene Symbol: RAMP2
  Gene Name: receptor (G protein-coupled) activity modifying protein 2
  Uniprot ID: O60895
  ENSP ID: ENSP00000253796
MASLRVERAGGPRLPRTRVGRPAALRLLLLLGAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 72069 - protein, 112 aa, Homo sapiens
  Payload ID: 14267
  Gene Symbol: RAMP2
  Gene Name: receptor (G protein-coupled) activity modifying protein 2
  ENSP ID: ENSP00000465725
MASLRVERAGGPRLPRTRVGRPAALRLLLLLGAVLNPHEALAQPLPTTGTPGSEGLIAPCEIAWSTLQSCLTWASPIPWQRGSSLRLTRSTLPTAPWCSPPSLTPQRMYSWP

SEQ ID NO: 72070 - protein, 180 aa, Homo sapiens
  Payload ID: 14267
  Gene Symbol: RAMP2
  Gene Name: receptor (G protein-coupled) activity modifying protein 2
  Uniprot ID: O60895
  ENSP ID: ENSP00000466455
MASLRVERAGGPRLPRTRVGRPAALRLLLLLGAVLNPHEALAQPLPTTGTPGSEASVPTGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 72071 - protein, 49 aa, Homo sapiens
  Payload ID: 14267
  Gene Symbol: RAMP2
  Gene Name: receptor (G protein-coupled) activity modifying protein 2
  ENSP ID: ENSP00000466980
MDPIEKDWCDWAMISRPYSTLRDCLEHFAELFDLGFPNPLAERIIFETH

SEQ ID NO: 72072 - protein, 100 aa, Homo sapiens
  Payload ID: 14267
  Gene Symbol: RAMP2
  Gene Name: receptor (G protein-coupled) activity modifying protein 2
  ENSP ID: ENSP00000467463
MDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 72073 - protein, 148 aa, Homo sapiens
  Payload ID: 14268
  Gene Symbol: RAMP3
  Gene Name: receptor (G protein-coupled) activity modifying protein 3
  Uniprot ID: O60896
  ENSP ID: ENSP00000242249
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLL

SEQ ID NO: 72074 - protein, 151 aa, Homo sapiens
  Payload ID: 14268
  Gene Symbol: RAMP3
  Gene Name: receptor (G protein-coupled) activity modifying protein 3
  ENSP ID: ENSP00000418460
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLLCGN

SEQ ID NO: 72075 - protein, 148 aa, Homo sapiens; identical to SEQ ID NO: 72073
  Payload ID: 14268
  Gene Symbol: RAMP3
  Gene Name: receptor (G protein-coupled) activity modifying protein 3
  Uniprot ID: O60896
  ENSP ID: ENSP00000419012

SEQ ID NO: 72076 - protein, 671 aa, Homo sapiens
  Payload ID: 14269
  Gene Symbol: RIPK1
  Gene Name: receptor (TNFRSF)-interacting serine-threonine kinase 1
  Uniprot ID: Q13546
  ENSP ID: ENSP00000259808
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEMSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 72077 - protein, 671 aa, Homo sapiens; identical to SEQ ID NO: 72076
  Payload ID: 14269
  Gene Symbol: RIPK1
  Gene Name: receptor (TNFRSF)-interacting serine-threonine kinase 1
  Uniprot ID: Q13546
  ENSP ID: ENSP00000369773

SEQ ID NO: 72078 - protein, 201 aa, Homo sapiens
  Payload ID: 14270
  Gene Symbol: REEP1
  Gene Name: receptor accessory protein 1
  Uniprot ID: Q9H902
  ENSP ID: ENSP00000165698
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 72079 - protein, 190 aa, Homo sapiens
  Payload ID: 14270
  Gene Symbol: REEP1
  Gene Name: receptor accessory protein 1
  ENSP ID: ENSP00000392197
MQKVLSNGQTEEVRSGSRLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHG

SEQ ID NO: 72080 - protein, 140 aa, Homo sapiens
  Payload ID: 14270
  Gene Symbol: REEP1
  Gene Name: receptor accessory protein 1
  ENSP ID: ENSP00000400607
MDHLQAGGVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAP

SEQ ID NO: 72081 - protein, 120 aa, Homo sapiens
  Payload ID: 14270
  Gene Symbol: REEP1
  Gene Name: receptor accessory protein 1
  ENSP ID: ENSP00000401140
MVSWIISRLVVLIFGTLYPAYYSYKAVKSKDIKEYVKWMMYWIIFALFTTAETFTDIFLCWDRVPYRRDCGASACRTSPPSGETAPLLPRAPHHRGLGGPAANTASLRCPGVLLRALAAQ

SEQ ID NO: 72082 - protein, 174 aa, Homo sapiens
  Payload ID: 14270
  Gene Symbol: REEP1
  Gene Name: receptor accessory protein 1
  Uniprot ID: Q9H902
  ENSP ID: ENSP00000437567
MDHLQAGGVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 72083 - protein, 208 aa, Homo sapiens
  Payload ID: 14270
  Gene Symbol: REEP1
  Gene Name: receptor accessory protein 1
  Uniprot ID: Q9H902
  ENSP ID: ENSP00000438346
MQKVLSNGQTEEVRSGSRLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 72084 - protein, 143 aa, Homo sapiens
  Payload ID: 14270
  Gene Symbol: REEP1
  Gene Name: receptor accessory protein 1
  Uniprot ID: Q9H902
  ENSP ID: ENSP00000442681
MVSWIISRLVVLIFGTLYPAYYSYKAVKSKDIKEYVKWMMYWIIFALFTTAETFTDIFLCWDRVPYRRDCGASACRTSPPSGETAPLLPRAPHHRGLGGPAANTASLRCPGVLLRALAAQAPPRILRSRFRKKSTSSSATETT

SEQ ID NO: 72085 - protein, 147 aa, Homo sapiens
  Payload ID: 14270
  Gene Symbol: REEP1
  Gene Name: receptor accessory protein 1
  ENSP ID: ENSP00000475269
  MOD_RES (1)..(1): Any amino acid
XSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKVLCWKYHNYMSLSPSSVPCSSPVRPHRTG

SEQ ID NO: 72086 - protein, 252 aa, Homo sapiens
  Payload ID: 14271
  Gene Symbol: REEP2
  Gene Name: receptor accessory protein 2
  Uniprot ID: Q9BRK0
  ENSP ID: ENSP00000254901
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 72087 - protein, 254 aa, Homo sapiens
  Payload ID: 14271
  Gene Symbol: REEP2
  Gene Name: receptor accessory protein 2
  Uniprot ID: Q9BRK0
  ENSP ID: ENSP00000367590
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 72088 - protein, 214 aa, Homo sapiens
  Payload ID: 14271
  Gene Symbol: REEP2
  Gene Name: receptor accessory protein 2
  ENSP ID: ENSP00000422530
MMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 72089 - protein, 40 aa, Homo sapiens
  Payload ID: 14271
  Gene Symbol: REEP2
  Gene Name: receptor accessory protein 2
  ENSP ID: ENSP00000424441
MVSWIISRLVVLIFGTLYPAYSSYKAVKTKNVKEYVPLLL

SEQ ID NO: 72090 - protein, 191 aa, Homo sapiens
  Payload ID: 14271
  Gene Symbol: REEP2
  Gene Name: receptor accessory protein 2
  ENSP ID: ENSP00000426658
  MOD_RES (1)..(1): Any amino acid
XLRAITRPLGLSLPLTVRRLGTRAYALRPPREEVWVSGSRNARRTKCERLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGQGVLSEKLRSFSM

SEQ ID NO: 72091 - protein, 151 aa, Homo sapiens
  Payload ID: 14271
  Gene Symbol: REEP2
  Gene Name: receptor accessory protein 2
  ENSP ID: ENSP00000479268
MMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGQGVLSEKLRSFSMQDLTLIRDEDALPLQRPDGPPTQPWQPPGHHRGLRR

SEQ ID NO: 72092 - protein, 255 aa, Homo sapiens
  Payload ID: 14272
  Gene Symbol: REEP3
  Gene Name: receptor accessory protein 3
  Uniprot ID: Q6NUK4
  ENSP ID: ENSP00000362863
MVSWMISRAVVLVFGMLYPAYYSYKAVKTKNVKEYVRWMMYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKSQGAITERLRSFSMHDLTTIQGDEPVGQRPYQPLPEAKKKSKPAPSESAGYGIPLKDGDEKTDEEAEGPYSDNEMLTHKGLRRSQSMKSVKTTKGRKEVRYGSLKYKVKKRPQVYF

SEQ ID NO: 72093 - protein, 84 aa, Homo sapiens
  Payload ID: 14272
  Gene Symbol: REEP3
  Gene Name: receptor accessory protein 3
  ENSP ID: ENSP00000489394
KIAFVIWLLSPYTKGASLIYRKFLHPLLSSKEREIDDYIVQAKERGYETMVNFGRQGLNLAATAAVTAAVKDFWLTSAPLLQSI

SEQ ID NO: 72094 - protein, 257 aa, Homo sapiens
  Payload ID: 14273
  Gene Symbol: REEP4
  Gene Name: receptor accessory protein 4
  Uniprot ID: Q9H6H4
  ENSP ID: ENSP00000303482
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYETVLSFGKRGLNIAASAAVQAATKSQGALAGRLRSFSMQDLRSISDAPAPAYHDPLYLEDQVSHRRPPIGYRAGGLQDSDTEDECWSDTEAVPRAPARPREKPLIRSQSLRVVKRKPPVREGTSRSLKVRTRKKTVPSDVDS

SEQ ID NO: 72095 - protein, 173 aa, Homo sapiens
  Payload ID: 14273
  Gene Symbol: REEP4
  Gene Name: receptor accessory protein 4
  Uniprot ID: Q9H6H4
  ENSP ID: ENSP00000333889
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYETVLSFGKRGLNIAASAAVQAATKGTGPGACRTATPRMSVGQILRQSPGRQPGPERSP

SEQ ID NO: 72096 - protein, 251 aa, Homo sapiens
  Payload ID: 14273
  Gene Symbol: REEP4
  Gene Name: receptor accessory protein 4
  ENSP ID: ENSP00000428709
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYETVLSFGKRGLNIAASAAVQAATKSQGALAGRLRSFSMQDLRSISDAPAPAYHDPLYLEDQVSHRRPPIGHLALPEGSDEEKDCALRRGQLGSAASAPFLPRALQGSRAIWRDLGLHIWPACTSCLGPTLLTPADG

SEQ ID NO: 72097 - protein, 55 aa, Homo sapiens
  Payload ID: 14273
  Gene Symbol: REEP4
  Gene Name: receptor accessory protein 4
  ENSP ID: ENSP00000429451
MVSWMICRLVVLVFGMLCPAYASYKAVKTKNIREYVSVGVWVRWMMYWIVFALFM

SEQ ID NO: 72098 - protein, 165 aa, Homo sapiens
  Payload ID: 14274
  Gene Symbol: REEP5
  Gene Name: receptor accessory protein 5
  ENSP ID: ENSP00000261482
MSAPRPGALFLLSCAVGADGGAPAGGRVDGGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEA

SEQ ID NO: 72099 - protein, 189 aa, Homo sapiens
  Payload ID: 14274
  Gene Symbol: REEP5
  Gene Name: receptor accessory protein 5
  Uniprot ID: Q00765
  ENSP ID: ENSP00000368959
MSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 72100 - protein, 145 aa, Homo sapiens
  Payload ID: 14274
  Gene Symbol: REEP5
  Gene Name: receptor accessory protein 5
  ENSP ID: ENSP00000421305
  MOD_RES (1)..(1): Any amino acid
XALGTAPSGETVPAMSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKVWSGLGFLLPRCLL

SEQ ID NO: 72101 - protein, 99 aa, Homo sapiens
  Payload ID: 14274
  Gene Symbol: REEP5
  Gene Name: receptor accessory protein 5
  ENSP ID: ENSP00000421881
MSAAMRERFDRFLHEKNCMTDLLAKLEAKTGVNRSFIALGVIGLVALYLVFGYGASLLCNLIGFGYPAYISVASCCGAWPRALLMGLNCSTSASSVLSS

SEQ ID NO: 72102 - protein, 122 aa, Homo sapiens
  Payload ID: 14274
  Gene Symbol: REEP5
  Gene Name: receptor accessory protein 5
  ENSP ID: ENSP00000425901
MSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKRRKLP

SEQ ID NO: 72103 - protein, 184 aa, Homo sapiens
  Payload ID: 14275
  Gene Symbol: REEP6
  Gene Name: receptor accessory protein 6
  Uniprot ID: Q96HR9
  ENSP ID: ENSP00000233596
MDGLRQRVEHFLEQRNLVTEVLGALEAKTGVEKRYLAAGAVTLLSLYLLFGYGASLLCNLIGFVYPAYASIKAIESPSKDDDTVWLTYWVVYALFGLAEFFSDLLLSWFPFYYVGKCAFLLFCMAPRPWNGALMLYQRVVRPLFLRHHGAVDRIMNDLSGRALDAAAGITRNVKPSQTPQPKDK

SEQ ID NO: 72104 - protein, 150 aa, Homo sapiens
  Payload ID: 14275
  Gene Symbol: REEP6
  Gene Name: receptor accessory protein 6
  ENSP ID: ENSP00000378861
  MOD_RES (1)..(1): Any amino acid
XFVYPAYASIKAIESPSKDDDTVWLTYWVVYALFGLAEFFSDLLLSWFPFYYVGKCAFLLFCMAPRPWNGALMLYQRVVRPLFLRHHGAVDRIMNDLSGRALDAAAGITRNVLQVLARSRAGITPVAVAGPSTPLEADLKPSQTPQPKDK

SEQ ID NO: 72105 - protein, 139 aa, Homo sapiens
  Payload ID: 14275
  Gene Symbol: REEP6
  Gene Name: receptor accessory protein 6
  ENSP ID: ENSP00000378865
AIESPSKDDDTVWLTYWVVYALFGLAEFFSDLLLSWFPFYYVGKCAFLLFCMAPRPWNGALMLYQRVVRPLFLRHHGAVDRIMNDLSGRALDAAAGITRNVLQVLARSRAGITPVAVAGPSTPLEADLKPSQTPQPKDK

SEQ ID NO: 72106 - protein, 937 aa, Homo sapiens
  Payload ID: 14276
  Gene Symbol: ROR1
  Gene Name: receptor tyrosine kinase-like orphan receptor 1
  Uniprot ID: Q01973
  ENSP ID: ENSP00000360120
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 72107 - protein, 393 aa, Homo sapiens
  Payload ID: 14276
  Gene Symbol: ROR1
  Gene Name: receptor tyrosine kinase-like orphan receptor 1
  Uniprot ID: Q01973
  ENSP ID: ENSP00000360121
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACGK

SEQ ID NO: 72108 - protein, 882 aa, Homo sapiens
  Payload ID: 14276
  Gene Symbol: ROR1
  Gene Name: receptor tyrosine kinase-like orphan receptor 1
  ENSP ID: ENSP00000441637
SYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 72109 - protein, 943 aa, Homo sapiens
  Payload ID: 14277
  Gene Symbol: ROR2
  Gene Name: receptor tyrosine kinase-like orphan receptor 2
  Uniprot ID: Q01974
  ENSP ID: ENSP00000364860
MARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 72110 - protein, 704 aa, Homo sapiens
  Payload ID: 14277
  Gene Symbol: ROR2
  Gene Name: receptor tyrosine kinase-like orphan receptor 2
  ENSP ID: ENSP00000364867
MKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVVRMRGSGRQCWMTETPNALLWHNVSGVGSCRWVRGLADFKDEATDFRVMPRDPSLHCHVTSTA

SEQ ID NO: 72111 - protein, 353 aa, Homo sapiens
  Payload ID: 14278
  Gene Symbol: RAPSN
  Gene Name: receptor-associated protein of the synapse
  Uniprot ID: Q13702
  ENSP ID: ENSP00000298853
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLELSQLKLHCLSESIYRSKGLQRELRAHVVRFHECVEETELYCGLCGESIGEKNSRLQALPCSHIFHLRCLQNNGTRSCPNCRRSSMKPGFV

SEQ ID NO: 72112 - protein, 412 aa, Homo sapiens
  Payload ID: 14278
  Gene Symbol: RAPSN
  Gene Name: receptor-associated protein of the synapse
  Uniprot ID: Q13702
  ENSP ID: ENSP00000298854
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLETAFPRYDSAMSIMTEIGNRLGQVQALLGVAKCWVARKALDKALDAIERAQDLAEEVGNKLSQLKLHCLSESIYRSKGLQRELRAHVVRFHECVEETELYCGLCGESIGEKNSRLQALPCSHIFHLRCLQNNGTRSCPNCRRSSMKPGFV

SEQ ID NO: 72113 - protein, 353 aa, Homo sapiens
  Payload ID: 14278
  Gene Symbol: RAPSN
  Gene Name: receptor-associated protein of the synapse
  ENSP ID: ENSP00000431732
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKDYEKALFFPCKAAELVNNYGKGWSLKYRAMSQYHMAVAYRLLGRLGSAMECCEESMKIALQHGDRPLQALCLLCFADIHRSRGDLELSQLKLHCLSESIYRSKGLQRELRAHVVRFHECVEETELYCGLCGESIGEKNSRLQALPCSHIFHLRWGLLGGWTGVGRISSGHSRAQLA

SEQ ID NO: 72114 - protein, 359 aa, Homo sapiens
  Payload ID: 14278
  Gene Symbol: RAPSN
  Gene Name: receptor-associated protein of the synapse
  ENSP ID: ENSP00000435551
MGQDQTKQQIEKGLQLYQSNQTEKALQVWTKVLEKSSDLMGRFRVLGCLVTAHSEMGRYKEMLKFAVVQIDTARELEDADFLLESYLNLARSNEKLCEFHKTISYCKTCLGLPGTRAGAQLGGQVSLSMGNAFLGLSVFQKALESFEKALRYAHNNDDAMLECRVCCSLGSFYAQVKESMKIALQHGDRPLQALCLLCFADIHRSRGDLETAFPRYDSAMSIMTEIGNRLGQVQALLGVAKCWVARKALDKALDAIERAQDLAEEVGNKLSQLKLHCLSESIYRSKGLQRELRAHVVRFHECVEETELYCGLCGESIGEKNSRLQALPCSHIFHLRCLQNNGTRSCPNCRRSSMKPGFV

SEQ ID NO: 72115 - protein, 540 aa, Homo sapiens
  Payload ID: 14279
  Gene Symbol: RIPK2
  Gene Name: receptor-interacting serine-threonine kinase 2
  Uniprot ID: O43353
  ENSP ID: ENSP00000220751
MNGEAICSALPTIPYHKLADLRYLSRGASGTVSSARHADWRVQVAVKHLHIHTPLLDSERKDVLREAEILHKARFSYILPILGICNEPEFLGIVTEYMPNGSLNELLHRKTEYPDVAWPLRFRILHEIALGVNYLHNMTPPLLHHDLKTQNILLDNEFHVKIADFGLSKWRMMSLSQSRSSKSAPEGGTIIYMPPENYEPGQKSRASIKHDIYSYAVITWEVLSRKQPFEDVTNPLQIMYSVSQGHRPVINEESLPYDIPHRARMISLIESGWAQNPDERPSFLKCLIELEPVLRTFEEITFLEAVIQLKKTKLQSVSSAIHLCDKKKMELSLNIPVNHGPQEESCGSSQLHENSGSPETSRSLPAPQDNDFLSRKAQDCYFMKLHHCPGNHSWDSTISGSQRAAFCDHKTTPCSSAIINPLSTAGNSERLQPGIAQQWIQSKREDIVNQMTEACLNQSLDALLSRDLIMKEDYELVSTKPTRTSKVRQLLDTTDIQGEEFAKVIVQKLKDNKQMGLQPYPEILVVSRSPSLNLLQNKSM

SEQ ID NO: 72116 - protein, 70 aa, Homo sapiens
  Payload ID: 14279
  Gene Symbol: RIPK2
  Gene Name: receptor-interacting serine-threonine kinase 2
  ENSP ID: ENSP00000427736
MNGEAICSALPTIPYHKLADLRYLSRGASGTVSSARHADWRVQVAVKHLHIHTPLLDRDLTRPSIQFLVS

SEQ ID NO: 72117 - protein, 68 aa, Homo sapiens
  Payload ID: 14279
  Gene Symbol: RIPK2
  Gene Name: receptor-interacting serine-threonine kinase 2
  ENSP ID: ENSP00000429271
MNGEAICSALPTIPYHKLADLRYLSRGASGTVSSARHADWRVQVAVKHLHIHTPLLDRKLNILMLLGH

SEQ ID NO: 72118 - protein, 518 aa, Homo sapiens
  Payload ID: 14280
  Gene Symbol: RIPK3
  Gene Name: receptor-interacting serine-threonine kinase 3
  Uniprot ID: Q9Y572
  ENSP ID: ENSP00000216274
MSCVKLWPSGAPAPLVSIEELENQELVGKGGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYSFGILMWAVLAGREVELPTEPSLVYEAVCNRQNRPSLAELPQAGPETPGLEGLKELMQLCWSSEPKDRPSFQECLPKTDEVFQMVENNMNAAVSTVKDFLSQLRSSNRRFSIPESGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGRPLVNIYNCSGVQVGDNNYLTMQQTTALPTWGLAPSGKGRGLQHPPPVGSQEGPKDPEAWSRPQGWYNHSGK

SEQ ID NO: 72119 - protein, 162 aa, Homo sapiens
  Payload ID: 14280
  Gene Symbol: RIPK3
  Gene Name: receptor-interacting serine-threonine kinase 3
  ENSP ID: ENSP00000451840
  MOD_RES (1)..(1): Any amino acid
XGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGTHSLPLSFPCSILPPDSSSRPISRFRVLCGGEGRR

SEQ ID NO: 72120 - protein, 231 aa, Homo sapiens
  Payload ID: 14280
  Gene Symbol: RIPK3
  Gene Name: receptor-interacting serine-threonine kinase 3
  Uniprot ID: Q9Y572
  ENSP ID: ENSP00000452328
MSCVKLWPSGAPAPLVSIEELENQELVGKGGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYSFGILMWAVLAGREVECKTLGGFWDP

SEQ ID NO: 72121 - protein, 832 aa, Homo sapiens
  Payload ID: 14281
  Gene Symbol: RIPK4
  Gene Name: receptor-interacting serine-threonine kinase 4
  Uniprot ID: P57078
  ENSP ID: ENSP00000330161
MEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQGNGLNGELIRQVLAALLPVTGRWRSPGEGFRLESEVIIRVTCPLSSPQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAMTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 72122 - protein, 784 aa, Homo sapiens
  Payload ID: 14281
  Gene Symbol: RIPK4
  Gene Name: receptor-interacting serine-threonine kinase 4
  Uniprot ID: P57078
  ENSP ID: ENSP00000332454
MEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAMTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 72123 - protein, 93 aa, Homo sapiens
  Payload ID: 14282
  Gene Symbol: RYK
  Gene Name: receptor-like tyrosine kinase
  ENSP ID: ENSP00000417836
  MOD_RES (1)..(1): Any amino acid
XKGKVKDIAISRERITLKDVLQEGTFGRIFHGILIDEKDPNKEKQAFVKTVKDQASEIQVTMMLTESCKLRGLHHRQFLSKTWYTWLFRLPVE

SEQ ID NO: 72124 - protein, 548 aa, Homo sapiens
  Payload ID: 14282
  Gene Symbol: RYK
  Gene Name: receptor-like tyrosine kinase
  ENSP ID: ENSP00000419122
SVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSSLGYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 72125 - protein, 610 aa, Homo sapiens
  Payload ID: 14282
  Gene Symbol: RYK
  Gene Name: receptor-like tyrosine kinase
  ENSP ID: ENSP00000478721
MRGAARLGRPGRSCLPGARGLRAPPPPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSSLGYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 72126 - protein, 607 aa, Homo sapiens
  Payload ID: 14282
  Gene Symbol: RYK
  Gene Name: receptor-like tyrosine kinase
  ENSP ID: ENSP00000485095
MRGAARLGRPGRSCLPGARGLRAPPPPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 72127 - protein, 157 aa, Homo sapiens
  Payload ID: 14282
  Gene Symbol: RYK
  Gene Name: receptor-like tyrosine kinase
  ENSP ID: ENSP00000487023
ESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVAPPCGAALFGVS

SEQ ID NO: 72128 - protein, 1043 aa, Homo sapiens
  Payload ID: 14283
  Gene Symbol: RAG1
  Gene Name: recombination activating gene 1
  Uniprot ID: P15918
  ENSP ID: ENSP00000299440
MAASFPPTLGLSSAPDEIQHPHIKFSEWKFKLFRVRSFEKTPEEAQKEKKDSFEGKPSLEQSPAVLDKADGQKPVPTQPLLKAHPKFSKKFHDNEKARGKAIHQANLRHLCRICGNSFRADEHNRRYPVHGPVDGKTLGLLRKKEKRATSWPDLIAKVFRIDVKADVDSIHPTEFCHNCWSIMHRKFSSAPCEVYFPRNVTMEWHPHTPSCDICNTARRGLKRKSLQPNLQLSKKLKTVLDQARQARQHKRRAQARISSKDVMKKIANCSKIHLSTKLLAVDFPEHFVKSISCQICEHILADPVETNCKHVFCRVCILRCLKVMGSYCPSCRYPCFPTDLESPVKSFLSVLNSLMVKCPAKECNEEVSLEKYNHHISSHKESKEIFVHINKGGRPRQHLLSLTRRAQKHRLRELKLQVKAFADKEEGGDVKSVCMTLFLLALRARNEHRQADELEAIMQGKGSGLQPAVCLAIRVNTFLSCSQYHKMYRTVKAITGRQIFQPLHALRNAEKVLLPGYHHFEWQPPLKNVSSSTDVGIIDGLSGLSSSVDDYPVDTIAKRFRYDSALVSALMDMEEDILEGMRSQDLDDYLNGPFTVVVKESCDGMGDVSEKHGSGPVVPEKAVRFSFTIMKITIAHSSQNVKVFEEAKPNSELCCKPLCLMLADESDHETLTAILSPLIAEREAMKSSELMLELGGILRTFKFIFRGTGYDEKLVREVEGLEASGSVYICTLCDATRLEASQNLVFHSITRSHAENLERYEVWRSNPYHESVEELRDRVKGVSAKPFIETVPSIDALHCDIGNAAEFYKIFQLEIGEVYKNPNASKEERKRWQATLDKHLRKKMNLKPIMRMNGNFARKLMTKETVDAVCELIPSEERHEALRELMDLYLKMKPVWRSSCPAKECPESLCQYSFNSQRFAELLSTKFKYRYEGKITNYFHKTLAHVPEIIERDGSIGAWASEGNESGNKLFRRFRKMNARQSKCYEMEDVLKHHWLYTSKYLQKFMNAHNALKTSGFTMNPQASLGDPLGIEDSLESQDSMEF

SEQ ID NO: 72129 - protein, 931 aa, Homo sapiens
  Payload ID: 14283
  Gene Symbol: RAG1
  Gene Name: recombination activating gene 1
  Uniprot ID: P15918
  ENSP ID: ENSP00000434610
MAASFPPTLGLSSAPDEIQHPHIKFSEWKFKLFRVRSFEKTPEEAQKEKKDSFEGKPSLEQSPAVLDKADGQKPVPTQPLLKAHPKFSKKFHDNEKARGKAIHQANLRHLCRICGNSFRADEHNRRYPVHGPVDGKTLGLLRKKEKRATSWPDLIAKVFRIDVKADVDSIHPTEFCHNCWSIMHRKFSSAPCEVYFPRNVTMEWHPHTPSCDICNTARRGLKRKSLQPNLQLSKKLKTVLDQARQARQHKRRAQARISSKDVMKKIANCSKIHLSTKLLAVDFPEHFVKSISCQICEHILADPVETNCKHVFCRVCILRCLKVMGSYCPSCRYPCFPTDLESPVKSFLSVLNSLMVKCPAKECNEEVSLEKYNHHISSHKESKEIFVHINKGGRPRQHLLSLTRRAQKHRLRELKLQVKAFADKEEGGDVKSVCMTLFLLALRARNEHRQADELEAIMQGKGSGLQPAVCLAIRVNTFLSCSQYHKMYRTVKAITGRQIFQPLHALRNAEKVLLPGYHHFEWQPPLKNVSSSTDVGIIDGLSGLSSSVDDYPVDTIAKRFRYDSALVSALMDMEEDILEGMRSQDLDDYLNGPFTVVVKESCDGMGDVSEKHGSGPVVPEKAVRFSFTIMKITIAHSSQNVKVFEEAKPNSELCCKPLCLMLADESDHETLTAILSPLIAEREAMKSSELMLELGGILRTFKFIFRGTGYDEKLVREVEGLEASGSVYICTLCDATRLEASQNLVFHSITRSHAENLERYEVWRSNPYHESVEELRDRVKGVSAKPFIETVPSIDALHCDIGNAAEFYKIFQLEIGEVYKNPNASKEERKRWQATLDKHLRKKMNLKPIMRMNGNFARKLMTKETVDAVCELIPSEERHEALRELMDLYLKMKPVWRSSCPAKECPESLCQYSFNSQRFAELLSTKFKYRN

SEQ ID NO: 72130 - protein, 527 aa, Homo sapiens
  Payload ID: 14284
  Gene Symbol: RAG2
  Gene Name: recombination activating gene 2
  Uniprot ID: P55895
  ENSP ID: ENSP00000308620
MSLQMVTVSNNIALIQPGFSLMNFDGQVFFFGQKGWPKRSCPTGVFHLDVKHNHVKLKPTIFSKDSCYLPPLRYPATCTFKGSLESEKHQYIIHGGKTPNNEVSDKIYVMSIVCKNNKKVTFRCTEKDLVGDVPEARYGHSINVVYSRGKSMGVLFGGRSYMPSTHRTTEKWNSVADCLPCVFLVDFEFGCATSYILPELQDGLSFHVSIAKNDTIYILGGHSLANNIRPANLYRIRVDLPLGSPAVNCTVLPGGISVSSAILTQTNNDEFVIVGGYQLENQKRMICNIISLEDNKIEIREMETPDWTPDIKHSKIWFGSNMGNGTVFLGIPGDNKQVVSEGFYFYMLKCAEDDTNEEQTTFTNSQTSTEDPGDSTPFEDSEEFCFSAEANSFDGDDEFDTYNEDDEEDESETGYWITCCPTCDVDINTWVPFYSTELNKPAMIYCSHGDGHWVHAQCMDLAERTLIHLSAGSNKYYCNEHVEIARALHTPQRVLPLKKPPMKSLRKKGSGKILTPAKKSFLRRLFD

SEQ ID NO: 72131 - protein, 1 aa, Homo sapiens
  Payload ID: 14284
  Gene Symbol: RAG2
  Gene Name: recombination activating gene 2
  ENSP ID: ENSP00000432174
M

SEQ ID NO: 72132 - protein, 150 aa, Homo sapiens
  Payload ID: 14284
  Gene Symbol: RAG2
  Gene Name: recombination activating gene 2
  ENSP ID: ENSP00000436327
MSLQMVTVSNNIALIQPGFSLMNFDGQVFFFGQKGWPKRSCPTGVFHLDVKHNHVKLKPTIFSKDSCYLPPLRYPATCTFKGSLESEKHQYIIHGGKTPNNEVSDKIYVMSIVCKNNKKVTFRCTEKDLVGDVPEARYGHSINVVYSRGK

SEQ ID NO: 72133 - protein, 70 aa, Homo sapiens
  Payload ID: 14284
  Gene Symbol: RAG2
  Gene Name: recombination activating gene 2
  ENSP ID: ENSP00000436895
MSLQMVTVSNNIALIQPGFSLMNFDGQVFFFGQKGWPKRSCPTGVFHLDVKHNHVKLKPTIFSKDSCYLP

SEQ ID NO: 72134 - protein, 527 aa, Homo sapiens; identical to SEQ ID NO: 72130
  Payload ID: 14284
  Gene Symbol: RAG2
  Gene Name: recombination activating gene 2
  Uniprot ID: P55895
  ENSP ID: ENSP00000478672

SEQ ID NO: 72135 - protein, 485 aa, Homo sapiens
  Payload ID: 14285
  Gene Symbol: RBPJ
  Gene Name: recombination signal binding protein for immunoglobulin kappa J region
  Uniprot ID: Q06330
  ENSP ID: ENSP00000305815
MGGCRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 72136 - protein, 487 aa, Homo sapiens
  Payload ID: 14285
  Gene Symbol: RBPJ
  Gene Name: recombination signal binding protein for immunoglobulin kappa J region
  Uniprot ID: Q06330
  ENSP ID: ENSP00000339699
MAPVVTGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 72137 - protein, 486 aa, Homo sapiens
  Payload ID: 14285
  Gene Symbol: RBPJ
  Gene Name: recombination signal binding protein for immunoglobulin kappa J region
  Uniprot ID: Q06330
  ENSP ID: ENSP00000340124
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 72138 - protein, 500 aa, Homo sapiens
  Payload ID: 14285
  Gene Symbol: RBPJ
  Gene Name: recombination signal binding protein for immunoglobulin kappa J region
  Uniprot ID: Q06330
  ENSP ID: ENSP00000345206
MDHTEGSPAEEPPAHAPSPGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 72139 - protein, 486 aa, Homo sapiens; identical to SEQ ID NO: 72137
  Payload ID: 14285
  Gene Symbol: RBPJ
  Gene Name: recombination signal binding protein for immunoglobulin kappa J region
  Uniprot ID: Q06330
  ENSP ID: ENSP00000347659

SEQ ID NO: 72140 - protein, 500 aa, Homo sapiens; identical to SEQ ID NO: 72138
  Payload ID: 14285
  Gene Symbol: RBPJ
  Gene Name: recombination signal binding protein for immunoglobulin kappa J region
  Uniprot ID: Q06330
  ENSP ID: ENSP00000354528

SEQ ID NO: 72141 - protein, 135 aa, Homo sapiens
  Payload ID: 14285
  Gene Symbol: RBPJ
  Gene Name: recombination signal binding protein for immunoglobulin kappa J region
  ENSP ID: ENSP00000421804
IIRKVDKQTALLDADDPVSQLHKCAFYLKDTERMYLCLSQERIIQFQLNGGGDVAMLELTGQNFTPNLRVWFGDVEAETMYRCGESMLCVVPDISAFREGWRWVRQPVQVPVTLVRNDGIIYSTSLTFTYTPEPG

SEQ ID NO: 72142 - protein, 157 aa, Homo sapiens
  Payload ID: 14285
  Gene Symbol: RBPJ
  Gene Name: recombination signal binding protein for immunoglobulin kappa J region
  ENSP ID: ENSP00000422617
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNR

SEQ ID NO: 72143 - protein, 107 aa, Homo sapiens
  Payload ID: 14285
  Gene Symbol: RBPJ
  Gene Name: recombination signal binding protein for immunoglobulin kappa J region
  ENSP ID: ENSP00000422838
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKN

SEQ ID NO: 72144 - protein, 189 aa, Homo sapiens
  Payload ID: 14285
  Gene Symbol: RBPJ
  Gene Name: recombination signal binding protein for immunoglobulin kappa J region
  ENSP ID: ENSP00000423406
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHL

SEQ ID NO: 72145 - protein, 110 aa, Homo sapiens
  Payload ID: 14285
  Gene Symbol: RBPJ
  Gene Name: recombination signal binding protein for immunoglobulin kappa J region
  ENSP ID: ENSP00000423575
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCT

SEQ ID NO: 72146 - protein, 178 aa, Homo sapiens
  Payload ID: 14285
  Gene Symbol: RBPJ
  Gene Name: recombination signal binding protein for immunoglobulin kappa J region
  ENSP ID: ENSP00000423644
MDHTEGSPAEEPPAHAPSPGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNAD

SEQ ID NO: 72147 - protein, 382 aa, Homo sapiens
  Payload ID: 14285
  Gene Symbol: RBPJ
  Gene Name: recombination signal binding protein for immunoglobulin kappa J region
  ENSP ID: ENSP00000423703
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQVWREYALCRPRHFCIPRRLEMGPATSPGSSNFGPK

SEQ ID NO: 72148 - protein, 465 aa, Homo sapiens
  Payload ID: 14285
  Gene Symbol: RBPJ
  Gene Name: recombination signal binding protein for immunoglobulin kappa J region
  Uniprot ID: Q06330
  ENSP ID: ENSP00000423907
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 72149 - protein, 143 aa, Homo sapiens
  Payload ID: 14285
  Gene Symbol: RBPJ
  Gene Name: recombination signal binding protein for immunoglobulin kappa J region
  ENSP ID: ENSP00000424459
MRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNAD

SEQ ID NO: 72150 - protein, 94 aa, Homo sapiens
  Payload ID: 14285
  Gene Symbol: RBPJ
  Gene Name: recombination signal binding protein for immunoglobulin kappa J region
  ENSP ID: ENSP00000424789
MAWIKRKFGERPPPKRLTREAMRNYLKERGDQTVLILHAKVAQKSYGNEKRFFCPPPCVYLMGSGWKKKKEQMERDGCSEQESQPCAFIGIGNS

SEQ ID NO: 72151 - protein, 49 aa, Homo sapiens
  Payload ID: 14285
  Gene Symbol: RBPJ
  Gene Name: recombination signal binding protein for immunoglobulin kappa J region
  ENSP ID: ENSP00000424804
MAWIKRKFGERPPPKRLTREAMRNYLKERGDQTVLILHAKVAQKSYGNE

SEQ ID NO: 72152 - protein, 48 aa, Homo sapiens
  Payload ID: 14285
  Gene Symbol: RBPJ
  Gene Name: recombination signal binding protein for immunoglobulin kappa J region
  ENSP ID: ENSP00000424989
MAWIKRKFGERPPPKRLTREAMRNYLKERGDQTVLILHAKVAQKSYGN

SEQ ID NO: 72153 - protein, 113 aa, Homo sapiens
  Payload ID: 14285
  Gene Symbol: RBPJ
  Gene Name: recombination signal binding protein for immunoglobulin kappa J region
  ENSP ID: ENSP00000425061
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKT

SEQ ID NO: 72154 - protein, 97 aa, Homo sapiens
  Payload ID: 14285
  Gene Symbol: RBPJ
  Gene Name: recombination signal binding protein for immunoglobulin kappa J region
  ENSP ID: ENSP00000425750
MAWIKRKFGERPPPKRLTREAMRNYLKERGDQTVLILHAKVAQKSYGNEKRFFCPPPCVYLMGSGWKKKKEQMERDGCSEQESQPCAFIGIGNSDQE

SEQ ID NO: 72155 - protein, 28 aa, Homo sapiens
  Payload ID: 14285
  Gene Symbol: RBPJ
  Gene Name: recombination signal binding protein for immunoglobulin kappa J region
  ENSP ID: ENSP00000426872
MAWIKRKFGERPPPKRLTREAMRNYLKE

SEQ ID NO: 72156 - protein, 229 aa, Homo sapiens
  Payload ID: 14285
  Gene Symbol: RBPJ
  Gene Name: recombination signal binding protein for immunoglobulin kappa J region
  ENSP ID: ENSP00000427170
MNLHFVFIFSKVIHSSWFLNTCLKIGLTFLCPWGAPTIFETMRKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVE

SEQ ID NO: 72157 - protein, 53 aa, Homo sapiens
  Payload ID: 14285
  Gene Symbol: RBPJ
  Gene Name: recombination signal binding protein for immunoglobulin kappa J region
  ENSP ID: ENSP00000427344
MAPVVTGKFGERPPPKRLTREAMRNYLKERGDQTVLILHAKVAQKSYGNEKRC

SEQ ID NO: 72158 - protein, 517 aa, Homo sapiens
  Payload ID: 14286
  Gene Symbol: RBPJL
  Gene Name: recombination signal binding protein for immunoglobulin kappa J region-like
  Uniprot ID: Q9UBG7
  ENSP ID: ENSP00000341243
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYRSPRSLVCVVPDVAAFCSDWRWLRAPITIPMSLVRADGLFYPSAFSFTYTPEYSVRPGHPGVPEPATDADALLESIHQEFTRTNFHLFIQT

SEQ ID NO: 72159 - protein, 471 aa, Homo sapiens
  Payload ID: 14286
  Gene Symbol: RBPJL
  Gene Name: recombination signal binding protein for immunoglobulin kappa J region-like
  ENSP ID: ENSP00000361826
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYRYGVEPAVPGVRGAGRGGLLQRLALAARSHHNPHEPGARRRALLP

SEQ ID NO: 72160 - protein, 516 aa, Homo sapiens
  Payload ID: 14286
  Gene Symbol: RBPJL
  Gene Name: recombination signal binding protein for immunoglobulin kappa J region-like
  Uniprot ID: Q9UBG7
  ENSP ID: ENSP00000361828
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYSPRSLVCVVPDVAAFCSDWRWLRAPITIPMSLVRADGLFYPSAFSFTYTPEYSVRPGHPGVPEPATDADALLESIHQEFTRTNFHLFIQT

SEQ ID NO: 72161 - protein, 184 aa, Homo sapiens
  Payload ID: 14286
  Gene Symbol: RBPJL
  Gene Name: recombination signal binding protein for immunoglobulin kappa J region-like
  ENSP ID: ENSP00000483978
  MOD_RES (1)..(1): Any amino acid
XDGHSAQGDFPPREGYVRYGSLVQLVCTVTGITLPPMIIRKVAKQCALLDVDEPISQLHKCAFQFPGSPPGGGGTYLCLATEKVVQFQHQPGVYPGAGHSGASHQHPRAERRGRRGHAGAPRRELPRGAQGVVWGRGGRNHVQEPAVPGVRGAGRGGLLQRLALAARSHHNPHEPGARRRALLP

SEQ ID NO: 72162 - protein, 200 aa, Homo sapiens
  Payload ID: 14287
  Gene Symbol: RCVRN
  Gene Name: recoverin
  Uniprot ID: P35243
  ENSP ID: ENSP00000226193
MGNSKSGALSKEILEELQLNTKFSEEELCSWYQSFLKDCPTGRITQQQFQSIYAKFFPDTDPKAYAQHVFRSFDSNLDGTLDFKEYVIALHMTTAGKTNQKLEWAFSLYDVDGNGTISKNEVLEIVMAIFKMITPEDVKLLPDDENTPEKRAEKIWKYFGKNDDDKLTEKEFIEGTLANKEILRLIQFEPQKVKEKMKNA

SEQ ID NO: 72163 - protein, 199 aa, Homo sapiens
  Payload ID: 14288
  Gene Symbol: RECQL
  Gene Name: RecQ helicase-like
  ENSP ID: ENSP00000318727
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKM

SEQ ID NO: 72164 - protein, 211 aa, Homo sapiens
  Payload ID: 14288
  Gene Symbol: RECQL
  Gene Name: RecQ helicase-like
  ENSP ID: ENSP00000379400
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKMFMSRLEKAYEAR

SEQ ID NO: 72165 - protein, 649 aa, Homo sapiens
  Payload ID: 14288
  Gene Symbol: RECQL
  Gene Name: RecQ helicase-like
  Uniprot ID: P46063
  ENSP ID: ENSP00000395449
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKMFMSRLEKAYEARRFTRIAVDEVHCCSQWGHDFRPDYKALGILKRQFPNASLIGLTATATNHVLTDAQKILCIEKCFTFTASFNRPNLYYEVRQKPSNTEDFIEDIVKLINGRYKGQSGIIYCFSQKDSEQVTVSLQNLGIHAGAYHANLEPEDKTTVHRKWSANEIQVVVATVAFGMGIDKPDVRFVIHHSMSKSMENYYQESGRAGRDDMKADCILYYGFGDIFRISSMVVMENVGQQKLYEMVSYCQNISKCRRVLMAQHFDEVWNSEACNKMCDNCCKDSAFERKNITEYCRDLIKILKQAEELNEKLTPLKLIDSWMGKGAAKLRVAGVVAPTLPREDLEKIIAHFLIQQYLKEDYSFTAYATISYLKIGPKANLLNNEAHAITMQVTKSTQNSFRAESSQTCHSEQGDKKMEEKNSGNFQKKAANMLQQSGSKNTGAKKRKIDDA

SEQ ID NO: 72166 - protein, 649 aa, Homo sapiens; identical to SEQ ID NO: 72165
  Payload ID: 14288
  Gene Symbol: RECQL
  Gene Name: RecQ helicase-like
  Uniprot ID: P46063
  ENSP ID: ENSP00000416739

SEQ ID NO: 72167 - protein, 106 aa, Homo sapiens
  Payload ID: 14288
  Gene Symbol: RECQL
  Gene Name: RecQ helicase-like
  ENSP ID: ENSP00000439069
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAG

SEQ ID NO: 72168 - protein, 72 aa, Homo sapiens
  Payload ID: 14288
  Gene Symbol: RECQL
  Gene Name: RecQ helicase-like
  ENSP ID: ENSP00000440700
MASVSALTEELDSITSELHAVEIQIQELTERQQELIQKKKVLTKKIKQCLEDSDAGASNEYDSSPAAWNKED

SEQ ID NO: 72169 - protein, 131 aa, Homo sapiens
  Payload ID: 14288
  Gene Symbol: RECQL
  Gene Name: RecQ helicase-like
  ENSP ID: ENSP00000445555
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSD

SEQ ID NO: 72170 - protein, 96 aa, Homo sapiens
  Payload ID: 14288
  Gene Symbol: RECQL
  Gene Name: RecQ helicase-like
  ENSP ID: ENSP00000446036
MASVSALTEELDSITSELHAVEIQIQELTERQQELIQKKKVLTKKIKQCLEDSDAGASNEYDSSPAAWNKEDFPWSGKVKDILQNVFKLEKFRPLQ

SEQ ID NO: 72171 - protein, 15 aa, Homo sapiens
  Payload ID: 14289
  Gene Symbol: RECQL4
  Gene Name: RecQ helicase-like 4
  ENSP ID: ENSP00000476318
  MOD_RES (1)..(1): Any amino acid
XEAAPEETRGAQAPP

SEQ ID NO: 72172 - protein, 37 aa, Homo sapiens
  Payload ID: 14289
  Gene Symbol: RECQL4
  Gene Name: RecQ helicase-like 4
  ENSP ID: ENSP00000476426
  MOD_RES (1)..(1): Any amino acid
XATTYTHCRLNCPGGPAQLQALAHRCAAWDRGACGVQ

SEQ ID NO: 72173 - protein, 352 aa, Homo sapiens
  Payload ID: 14289
  Gene Symbol: RECQL4
  Gene Name: RecQ helicase-like 4
  ENSP ID: ENSP00000476551
  MOD_RES (1)..(1): Any amino acid
XLLRKQAWKQKWRKKGECFGGGGATVTTKESCFLNEQFDHWAAQCPRPASEEDTDAVGPEPLVPSPQPVPEVPSLDPTVLPLYSLGPSGQLAETPAEVFQALEQLGHQAFRPGQERAVMRILSGAGKSLCYQLPALLYSRRSPCLTLVVSPLLSLMDDQVSGLPPCLKAACIHSGMTRKQRESVLQKIRAAQVHVLMLTPEALVGAGGLPPAAQLPPVAFACIDEAHCLSQWSHNFRPCYLRVCKVLRERMGVHCFLGLTATATRRTASDVAQHLAVAEEPDLHGPAPVPTNLHLSVSMDRDTDQALLTLLQGKRFQNLDSIIIYCNRREDTERIAALLRTCLHAAWVPGSG

SEQ ID NO: 72174 - protein, 229 aa, Homo sapiens
  Payload ID: 14289
  Gene Symbol: RECQL4
  Gene Name: RecQ helicase-like 4
  ENSP ID: ENSP00000476579
  MOD_RES (1)..(1): Any amino acid
XEYRTLKRTTGQAGGGLRSSESLPAAAEEAPEPRCWGPHLNRAATKSPQSTPGRSRQGSVPDYGQRLKANLKGTLQGPEASAFQEVSIRVGSPQPSSSGGEKRRWNEEPWESPAQVQQESSQAGPPSEGAGAVAVEEDPPGEPVQAQPPQPCSSPSNPRYHGLSPSSQARAGKAEGTAPLHIFPRLARHDRGNYVRLNMKQKHYVRGRALRSRLLRKQAWKQKWRKKGE

SEQ ID NO: 72175 - protein, 389 aa, Homo sapiens
  Payload ID: 14289
  Gene Symbol: RECQL4
  Gene Name: RecQ helicase-like 4
  ENSP ID: ENSP00000477457
  MOD_RES (1)..(1): Any amino acid
XPPCLKAACIHSGMTRKQRESVLQKIRAAQVHVLMLTPEALVGAGGLPPAAQLPPVAFACIDEAHCLSQWSHNFRPCYLRVCKVLRERMGVHCFLGLTATATRRTASDVAQHLAVAEEPDLHGPAPVPTNLHLSVSMDRDTDQALLTLLQGKRFQNLDSIIIYCNRREDTERIAALLRTCLHAAWVPGSGGRAPKTTAEAYHAGMCSRERRRGEDLRELRRHVHADSTDFLAVKRLVQRVFPACTCTCTRPPSEQEGAVGGERPVPKYPPQEAEQLSHQAAPGPRRVCMGHERALPIQLTVQALDMPEEAIETLLCYLELHPHHWLELLATTYTHCRLNCPGGPAQLQALAHRCPPLAVCLAQQLPEDPGQGSSSVEFDMVKLVDSMGW

SEQ ID NO: 72176 - protein, 293 aa, Homo sapiens
  Payload ID: 14289
  Gene Symbol: RECQL4
  Gene Name: RecQ helicase-like 4
  ENSP ID: ENSP00000477910
AIETLLCYLELHPHHWLELLATTYTHCRLNCPGGPAQLQALAHRCPPLAVCLAQQLPEDPGQGSSSVEFDMVKLVDSMGWELASVRRALCQLQWDHEPRTGVRRGTGVLVEFSELAFHLRSPGDLTAEEKDQICDFLYGRVQARERQALARLRRTFQAFHSVAFPSCGPCLEQQDEERSTRLKDLLGRYFEEEEGQEPGGMEDAQGPEPGQARVSALQDWEDQVRCDIRQFLSLRPEEKFSSRAVARIFHGIGSPCYPAQVYGQDRRFWRKYLHLSFHALVGLATEELLQVAR

SEQ ID NO: 72177 - protein, 1208 aa, Homo sapiens
  Payload ID: 14289
  Gene Symbol: RECQL4
  Gene Name: RecQ helicase-like 4
  ENSP ID: ENSP00000482313
MERLRDVRERLQAWERAFRRQRGRRPSQDDVEAAPEETRALYREYRTLKRTTGQAGGGLRSSESLPAAAEEAPEPRCWGPHLNRAATKSPQSTPGRSRQGSVPDYGQRLKANLKGTLQAGPALGRRPWPLGRASSKASTPKPPGTGPVPSFAEKVSDEPPQLPEPQPRPGRLQHLQASLSQRLGSLDPGWLQRCHSEVPDFLGAPKACRPDLGSEESQLLIPGESAVLGPGAGSQGPEASAFQEVSIRVGSPQPSSSGGEKRRWNEEPWESPAQVQQESSQAGPPSEGAGAVAVEEDPPGEPVQAQPPQPCSSPSNPRYHGLSPSSQARAGKAEGTAPLHIFPRLARHDRGNYVRLNMKQKHYVRGRALRSRLLRKQAWKQKWRKKGECFGGGGATVTTKESCFLNEQFDHWAAQCPRPASEEDTDAVGPEPLVPSPQPVPEVPSLDPTVLPLYSLGPSGQLAETPAEVFQALEQLGHQAFRPGQERAVMRILSGISTLLVLPTGAGKSLCYQLPALLYSRRSPCLTLVVSPLLSLMDDQVSGLPPCLKAACIHSGMTRKQRESVLQKIRAAQVHVLMLTPEALVGAGGLPPAAQLPPVAFACIDEAHCLSQWSHNFRPCYLRVCKVLRERMGVHCFLGLTATATRRTASDVAQHLAVAEEPDLHGPAPVPTNLHLSVSMDRDTDQALLTLLQGKRFQNLDSIIIYCNRREDTERIAALLRTCLHAAWVPGSGGRAPKTTAEAYHAGMCSRERRRVQRAFMQGQLRVVVATVAFGMGLDRPDVRAVLHLGLPPSFESYVQAVGRAGRDGQPAHCHLFLQPQGEDLRELRRHVHADSTDFLAVKRLVQRVFPACTCTCTRPPSEQEGAVGGERPVPKYPPQEAEQLSHQAAPGPRRVCMGHERALPIQLTVQALDMPEEAIETLLCYLELHPHHWLELLATTYTHCRLNCPGGPAQLQALAHRCPPLAVCLAQQLPEDPGQGSSSVEFDMVKLVDSMGWELASVRRALCQLQWDHEPRTGVRRGTGVLVEFSELAFHLRSPGDLTAEEKDQICDFLYGRVQARERQALARLRRTFQAFHSVAFPSCGPCLEQQDEERSTRLKDLLGRYFEEEEGQEPGGMEDAQGPEPGQARLQDWEDQVRCDIRQFLSLRPEEKFSSRAVARIFHGIGSPCYPAQVYGQDRRFWRKYLHLSFHALVGLATEELLQVAR

SEQ ID NO: 72178 - protein, 851 aa, Homo sapiens
  Payload ID: 14289
  Gene Symbol: RECQL4
  Gene Name: RecQ helicase-like 4
  ENSP ID: ENSP00000483145
MKQKHYVRGRALRSRLLRKQAWKQKWRKKGECFGGGGATVTTKESCFLNEQFDHWAAQCPRPASEEDTDAVGPEPLVPSPQPVPEVPSLDPTVLPLYSLGPSGQLAETPAEVFQALEQLGHQAFRPGQERAVMRILSGISTLLVLPTGAGKSLCYQLPALLYSRRSPCLTLVVSPLLSLMDDQVSGLPPCLKAACIHSGMTRKQRESVLQKIRAAQVHVLMLTPEALVGAGGLPPAAQLPPVAFACIDEAHCLSQWSHNFRPCYLRVCKVLRERMGVHCFLGLTATATRRTASDVAQHLAVAEEPDLHGPAPVPTNLHLSVSMDRDTDQALLTLLQGKRFQNLDSIIIYCNRREDTERIAALLRTCLHAAWVPGSGGRAPKTTAEAYHAGMCSRERRRVQRAFMQGQLRVVVATVAFGMGLDRPDVRAVLHLGLPPSFESYVQAVGRAGRDGQPAHCHLFLQPQGEDLRELRRHVHADSTDFLAVKRLVQRVFPACTCTCTRPPSEQEGAVGGERPVPKYPPQEAEQLSHQAAPGPRRVCMGHERALPIQLTVQALDMPEEAIETLLCYLELHPHHWLELLATTYTHCRLNCPGGPAQLQALAHRCPPLAVCLAQQLPEDPGQGSSSVEFDMVKLVDSMGWELASVRRALCQLQWDHEPRTGVRRGTGVLVEFSELAFHLRSPGDLTAEEKDQICDFLYGRVQARERQALARLRRTFQAFHSVAFPSCGPCLEQQDEERSTRLKDLLGRYFEEEEGQEPGGMEDAQGPEPGQARLQDWEDQVRCDIRQFLSLRPEEKFSSRAVARIFHGIGSPCYPAQVYGQDRRFWRKYLHLSFHALVGLATEELLQVAR

SEQ ID NO: 72179 - protein, 991 aa, Homo sapiens
  Payload ID: 14290
  Gene Symbol: RECQL5
  Gene Name: RecQ helicase-like 5
  Uniprot ID: O94762
  ENSP ID: ENSP00000317636
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 72180 - protein, 435 aa, Homo sapiens
  Payload ID: 14290
  Gene Symbol: RECQL5
  Gene Name: RecQ helicase-like 5
  Uniprot ID: O94762
  ENSP ID: ENSP00000341983
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGRWGRGHGKSLRAAWCSQVVSRHAEL

SEQ ID NO: 72181 - protein, 964 aa, Homo sapiens
  Payload ID: 14290
  Gene Symbol: RECQL5
  Gene Name: RecQ helicase-like 5
  Uniprot ID: O94762
  ENSP ID: ENSP00000394820
MSSHHTTFPFDPERRVRSTLKKVFGFDSFKTPLQESATMAVVKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 72182 - protein, 410 aa, Homo sapiens
  Payload ID: 14290
  Gene Symbol: RECQL5
  Gene Name: RecQ helicase-like 5
  Uniprot ID: O94762
  ENSP ID: ENSP00000414933
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELG

SEQ ID NO: 72183 - protein, 118 aa, Homo sapiens
  Payload ID: 14290
  Gene Symbol: RECQL5
  Gene Name: RecQ helicase-like 5
  ENSP ID: ENSP00000462077
  MOD_RES (1)..(1): Any amino acid
XFGMGVDKANVRFVAHWNIAKSMAGYYQESGRAGRDGKPSWCRLYYSRNDRDQVSFLIRKEVAKLQEKRGNKASDKATIMAFDALVTFCEELGRWGRGHGKSLRAAWCSQVVSRHAEL

SEQ ID NO: 72184 - protein, 435 aa, Homo sapiens; identical to SEQ ID NO: 72180
  Payload ID: 14290
  Gene Symbol: RECQL5
  Gene Name: RecQ helicase-like 5
  Uniprot ID: O94762
  ENSP ID: ENSP00000462248

SEQ ID NO: 72185 - protein, 236 aa, Homo sapiens
  Payload ID: 14290
  Gene Symbol: RECQL5
  Gene Name: RecQ helicase-like 5
  ENSP ID: ENSP00000462291
KGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPRPPGMREPPGPSAVMPALPSTSTCPPRDQGTPEVQPTPAKDTWKGKRPRSQQENPESQPQKRPRPSA

SEQ ID NO: 72186 - protein, 198 aa, Homo sapiens
  Payload ID: 14290
  Gene Symbol: RECQL5
  Gene Name: RecQ helicase-like 5
  ENSP ID: ENSP00000462547
  MOD_RES (1)..(1): Any amino acid
XSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGVCRPLEYCQVYGWVLPGVWPGWQGWEAFLVPSLLLQE

SEQ ID NO: 72187 - protein, 206 aa, Homo sapiens
  Payload ID: 14290
  Gene Symbol: RECQL5
  Gene Name: RecQ helicase-like 5
  ENSP ID: ENSP00000462678
  MOD_RES (1)..(1): Any amino acid
XLLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKPIDPSQSGPHGWVFWDTCRGQKVEGGGAAAGRRGRKSGPSPSSKSG

SEQ ID NO: 72188 - protein, 480 aa, Homo sapiens
  Payload ID: 14290
  Gene Symbol: RECQL5
  Gene Name: RecQ helicase-like 5
  ENSP ID: ENSP00000463099
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGD

SEQ ID NO: 72189 - protein, 190 aa, Homo sapiens
  Payload ID: 14290
  Gene Symbol: RECQL5
  Gene Name: RecQ helicase-like 5
  ENSP ID: ENSP00000463701
MQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLL

SEQ ID NO: 72190 - protein, 625 aa, Homo sapiens
  Payload ID: 14291
  Gene Symbol: RMI1
  Gene Name: RecQ mediated genome instability 1
  Uniprot ID: Q9H9A7
  ENSP ID: ENSP00000317039
MNVTSIALRAETWLLAAWHVKVPPMWLEACINWIQEENNNVNLSQAQMNKQVFEQWLLTDLRDLEHPLLPDGILEIPKGELNGFYALQINSLVDVSQPAYSQIQKLRGKNTTNDLVTAEAQVTPKPWEAKPSRMLMLQLTDGIVQIQGMEYQPIPILHSDLPPGTKILIYGNISFRLGVLLLKPENVKVLGGEVDALLEEYAQEKVLARLIGEPDLVVSVIPNNSNENIPRVTDVLDPALGPSDEELLASLDENDELTANNDTSSERCFTTGSSSNTIPTRQSSFEPEFVISPRPKEEPSNLSIHVMDGELDDFSLEEALLLEETVQKEQMETKELQPLTFNRNADRSIERFSHNPNTTNNFSLTCKNGNNNWSEKNVSEQMTNEDKSFGCPSVRDQNRSIFSVHCNVPLAHDFTNKEKNLETDNKIKQTSSSDSHSLNNKILNREVVNYVQKRNSQISNENDCNLQSCSLRSSENSINLSIAMDLYSPPFVYLSVLMASKPKEVTTVKVKAFIVTLTGNLSSSGGIWSITAKVSDGTAYLDVDFVDEILTSLIGFSVPEMKQSKKDPLQYQKFLEGLQKCQRDLIDLCCLMTISFNPSLSKAMVLALQDVNMEHLENLKKRLNK

SEQ ID NO: 72191 - protein, 415 aa, Homo sapiens
  Payload ID: 14291
  Gene Symbol: RMI1
  Gene Name: RecQ mediated genome instability 1
  ENSP ID: ENSP00000402433
MNVTSIALRAETWLLAAWHVKVPPMWLEACINWIQEENNNVNLSQAQMNKQVFEQWLLTDLRDLEHPLLPDGILEIPKGELNGFYALQINSLVDVSQPAYSQIQKLRGKNTTNDLVTAEAQVTPKPWEAKPSRMLMLQLTDGIVQIQGMEYQPIPILHSDLPPGTKILIYGNISFRLGVLLLKPENVKVLGGEVDALLEEYAQEKVLARLIGEPDLVVSVIPNNSNENIPRVTDVLDPALGPSDEELLASLDENDELTANNDTSSERCFTTGSSSNTIPTRQSSFEPEFVISPRPKEEPSNLSIHVMDGELDDFSLEEALLLEETVQKEQMETKELQPLTFNRNADRSIERFSHNPNTTNNFSLTCKNGNNNWSEKNVSEQMTNEDKSFGCPSVRDQNRSIFSVHCNVPLAHDFT

SEQ ID NO: 72192 - protein, 470 aa, Homo sapiens
  Payload ID: 14291
  Gene Symbol: RMI1
  Gene Name: RecQ mediated genome instability 1
  ENSP ID: ENSP00000483816
MNVTSIALRAETWLLAAWHVKVPPMWLEACINWIQEENNNVNLSQAQMNKQVFEQWLLTDLRDLEHPLLPDGILEIPKGELNGFYALQINSLVDVSQPAYSQIQKLRGKNTTNDLVTAEAQVTPKPWEAKPSRMLMLQLTDGIVQIQGMEYQPIPILHSDLPPGTKILIYGNISFRLGVLLLKPENVKVLGGEVDALLEEYAQEKVLARLIGEPDLVVSVIPNNSNENIPRVTDVLDPALGPSDEELLASLDENDELTANNDTSSERCFTTGSSSNTIPTRQSSFEPEFVISPRPKEEPSNLSIHVMDGELDDFSLEEALLLEETVQKEQMETKELQPLTFNRNADRSIERFSHNPNTTNNFSLTCKNGNNNWSEKNVSEQMTNEDKSFGCPSVRDQNRSIFSVHCNVPLAHDFTNKEKNLETDNKIKQTSSSDSHSLNNKILIERWSTMYRKGIHKFLMKMIVIYRVVL

SEQ ID NO: 72193 - protein, 147 aa, Homo sapiens
  Payload ID: 14292
  Gene Symbol: RMI2
  Gene Name: RecQ mediated genome instability 2
  Uniprot ID: Q96E14
  ENSP ID: ENSP00000310356
MAAAADSFSGGPAGVRLPRSPPLKVLAEQLRRDAEGGPGAWRLSRAAAGRGPLDLAAVWMQGRVVMADRGEARLRDPSGDFSVRGLERVPRGRPCLVPGKYVMVMGVVQACSPEPCLQAVKMTDLSDNPIHESMWELEVEDLHRNIP

SEQ ID NO: 72194 - protein, 27 aa, Homo sapiens
  Payload ID: 14292
  Gene Symbol: RMI2
  Gene Name: RecQ mediated genome instability 2
  ENSP ID: ENSP00000459601
MAAAADSFSGGPAGVRLPRSPPLKESM

SEQ ID NO: 72195 - protein, 84 aa, Homo sapiens
  Payload ID: 14292
  Gene Symbol: RMI2
  Gene Name: RecQ mediated genome instability 2
  Uniprot ID: Q96E14
  ENSP ID: ENSP00000461206
MKQTQVGSLFSLGIRNPEPGPVSGTAVPRQLAWKSGKYVMVMGVVQACSPEPCLQAVKMTDLSDNPIHESMWELEVEDLHRNIP

SEQ ID NO: 72196 - protein, 3458 aa, Homo sapiens
  Payload ID: 14293
  Gene Symbol: RELN
  Gene Name: reelin
  Uniprot ID: P78509
  ENSP ID: ENSP00000345694
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLTRKQNYMMNFSRQHGLRHFYNRRRRSLRRYP

SEQ ID NO: 72197 - protein, 3460 aa, Homo sapiens [sequence omitted]

SEQ ID NO: 72198 - protein, 3460 aa, Homo sapiens
  Payload ID: 14293
  Gene Symbol: RELN
  Gene Name: reelin
  Uniprot ID: P78509
  ENSP ID: ENSP00000392423
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 72199 - protein, 68 aa, Homo sapiens
  Payload ID: 14293
  Gene Symbol: RELN
  Gene Name: reelin
  ENSP ID: ENSP00000404818
  MOD_RES (1)..(1): Any amino acid
XLRWWQPRHNGTGHDQWALDHVEVVLDEKSYIASKPDQTFMTNHSAACIERHFLTCVIFHYLLSLVFH

SEQ ID NO: 72200 - protein, 166 aa, Homo sapiens
  Payload ID: 14294
  Gene Symbol: REG1A
  Gene Name: regenerating islet-derived 1 alpha
  Uniprot ID: P05451
  ENSP ID: ENSP00000233735
MAQTSSYFMLISCLMFLSQSQGQEAQTELPQARISCPEGTNAYRSYCYYFNEDRETWVDADLYCQNMNSGNLVSVLTQAEGAFVASLIKESGTDDFNVWIGLHDPKKNRRWHWSSGSLVSYKSWGIGAPSSVNPGYCVSLTSSTGFQKWKDVPCEDKFSFVCKFKN

SEQ ID NO: 72201 - protein, 166 aa, Homo sapiens
  Payload ID: 14295
  Gene Symbol: REG1B
  Gene Name: regenerating islet-derived 1 beta
  Uniprot ID: P48304
  ENSP ID: ENSP00000303206
MAQTNSFFMLISSLMFLSLSQGQESQTELPNPRISCPEGTNAYRSYCYYFNEDPETWVDADLYCQNMNSGNLVSVLTQAEGAFVASLIKESSTDDSNVWIGLHDPKKNRRWHWSSGSLVSYKSWDTGSPSSANAGYCASLTSCSGFKKWKDESCEKKFSFVCKFKN

SEQ ID NO: 72202 - protein, 149 aa, Homo sapiens
  Payload ID: 14295
  Gene Symbol: REG1B
  Gene Name: regenerating islet-derived 1 beta
  ENSP ID: ENSP00000387410
FNEDPETWVDADLYCQNMNSGNLVSVLTQAEGAFVASLIKESSTDDSNVWIGLHDPKKNRRWHWSSGSLVSYKSWDTGSPSSANAGYCASLTSCSGERQTIYPPVAISFPLISGDEHGDWDRGKDSRNGRMNLVRRSSPLFASSKTRGS

SEQ ID NO: 72203 - protein, 175 aa, Homo sapiens
  Payload ID: 14296
  Gene Symbol: REG3A
  Gene Name: regenerating islet-derived 3 alpha
  Uniprot ID: Q06141
  ENSP ID: ENSP00000304311
MLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 72204 - protein, 175 aa, Homo sapiens; identical to SEQ ID NO: 72203
  Payload ID: 14296
  Gene Symbol: REG3A
  Gene Name: regenerating islet-derived 3 alpha
  Uniprot ID: Q06141
  ENSP ID: ENSP00000377456

SEQ ID NO: 72205 - protein, 175 aa, Homo sapiens; identical to SEQ ID NO: 72203
  Payload ID: 14296
  Gene Symbol: REG3A
  Gene Name: regenerating islet-derived 3 alpha
  Uniprot ID: Q06141
  ENSP ID: ENSP00000386630

SEQ ID NO: 72206 - protein, 175 aa, Homo sapiens
  Payload ID: 14297
  Gene Symbol: REG3G
  Gene Name: regenerating islet-derived 3 gamma
  Uniprot ID: Q6UW15
  ENSP ID: ENSP00000272324
MLPPMALPSVSWMLLSCLILLCQVQGEETQKELPSPRISCPKGSKAYGSPCYALFLSPKSWMDADLACQKRPSGKLVSVLSGAEGSFVSSLVRSISNSYSYIWIGLHDPTQGSEPDGDGWEWSSTDVMNYFAWEKNPSTILNPGHCGSLSRSTGFLKWKDYNCDAKLPYVCKFKD

SEQ ID NO: 72207 - protein, 175 aa, Homo sapiens; identical to SEQ ID NO: 72206
  Payload ID: 14297
  Gene Symbol: REG3G
  Gene Name: regenerating islet-derived 3 gamma
  Uniprot ID: Q6UW15
  ENSP ID: ENSP00000377475

SEQ ID NO: 72208 - protein, 129 aa, Homo sapiens
  Payload ID: 14297
  Gene Symbol: REG3G
  Gene Name: regenerating islet-derived 3 gamma
  Uniprot ID: Q6UW15
  ENSP ID: ENSP00000387105
MLPPMALPSVSWMLLSCLILLCQVQGEETQKELPSPRISCPKGSKAYGSPCYALFLSPKSWMDADGSEPDGDGWEWSSTDVMNYFAWEKNPSTILNPGHCGSLSRSTGFLKWKDYNCDAKLPYVCKFKD

SEQ ID NO: 72209 - protein, 158 aa, Homo sapiens
  Payload ID: 14298
  Gene Symbol: REG4
  Gene Name: regenerating islet-derived family, member 4
  Uniprot ID: Q9BYZ8
  ENSP ID: ENSP00000256585
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEMSSNNNFLTWSSNECNKRQHFLCKYRP

SEQ ID NO: 72210 - protein, 158 aa, Homo sapiens; identical to SEQ ID NO: 72209
  Payload ID: 14298
  Gene Symbol: REG4
  Gene Name: regenerating islet-derived family, member 4
  Uniprot ID: Q9BYZ8
  ENSP ID: ENSP00000346158

SEQ ID NO: 72211 - protein, 134 aa, Homo sapiens
  Payload ID: 14298
  Gene Symbol: REG4
  Gene Name: regenerating islet-derived family, member 4
  Uniprot ID: Q9BYZ8
  ENSP ID: ENSP00000358409
MASRSMRLLLLLSCLAKTGVLGDIIMRPSCAPGWFYHKSNCYGYFRKLRNWSDAEVRNLLPAWPGLSRAKDQPEPQISFDSGSSVLPGHYEEKPLWLVKWREEGCVFNSFNSVSIAEAGAVCQTLDGLQAHTDT

SEQ ID NO: 72212 - protein, 103 aa, Homo sapiens
  Payload ID: 14298
  Gene Symbol: REG4
  Gene Name: regenerating islet-derived family, member 4
  ENSP ID: ENSP00000437135
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKTF

SEQ ID NO: 72213 - protein, 299 aa, Homo sapiens
  Payload ID: 14299
  Gene Symbol: RGN
  Gene Name: regucalcin
  Uniprot ID: Q15493
  ENSP ID: ENSP00000253303
MSSIKIECVLPENCRCGESPVWEEVSNSLLFVDIPAKKVCRWDSFTKQVQRVTMDAPVSSVALRQSGGYVATIGTKFCALNWKEQSAVVLATVDNDKKNNRFNDGKVDPAGRYFAGTMAEETAPAVLERHQGALYSLFPDHHVKKYFDQVDISNGLDWSLDHKIFYYIDSLSYSVDAFDYDLQTGQISNRRSVYKLEKEEQIPDGMCIDAEGKLWVACYNGGRVIRLDPVTGKRLQTVKLPVDKTTSCCFGGKNYSEMYVTCARDGMDPEGLLRQPEAGGIFKITGLGVKGIAPYSYAG

SEQ ID NO: 72214 - protein, 299 aa, Homo sapiens; identical to SEQ ID NO: 72213
  Payload ID: 14299
  Gene Symbol: RGN
  Gene Name: regucalcin
  Uniprot ID: Q15493
  ENSP ID: ENSP00000338400

SEQ ID NO: 72215 - protein, 299 aa, Homo sapiens; identical to SEQ ID NO: 72213
  Payload ID: 14299
  Gene Symbol: RGN
  Gene Name: regucalcin
  Uniprot ID: Q15493
  ENSP ID: ENSP00000380365

SEQ ID NO: 72216 - protein, 227 aa, Homo sapiens
  Payload ID: 14299
  Gene Symbol: RGN
  Gene Name: regucalcin
  Uniprot ID: Q15493
  ENSP ID: ENSP00000406568
MSSIKIECVLPENCRCGESPVWEEVSNSLLFVDIPAKKVCRWDSFTKQVQRVTMDAPVSSVALRQSGGYVATIGTKFCALNWKEQSAVVLATVDNDKKNNRFNDGKVDPAGRYFAANRRSVYKLEKEEQIPDGMCIDAEGKLWVACYNGGRVIRLDPVTGKRLQTVKLPVDKTTSCCFGGKNYSEMYVTCARDGMDPEGLLRQPEAGGIFKITGLGVKGIAPYSYAG

SEQ ID NO: 72217 - protein, 228 aa, Homo sapiens
  Payload ID: 14300
  Gene Symbol: RESP18
  Gene Name: regulated endocrine-specific protein 18
  Uniprot ID: Q5W5W9
  ENSP ID: ENSP00000330269
MAVDVEFGVAGWWEAAAPLSPSAVAATFTETWPGSERAEPGRIQHPLWPGSSEGLQLLVCFLLLNSCPGGCSDTSAHDGQDQVGVGQLWPLQGFATPVFQHLQVVLQQIIPQGLFWKDDITQDAMIQKMEHASRLHPQEPCLKDGKALFPTKTTESPLAKVNRDQCFTSEVVSKALKQEVANPVKITYRCSYGGLDMMQAPGPSKEEIIYKIMRLLWATSYCGPQPCG

SEQ ID NO: 72218 - protein, 91 aa, Homo sapiens
  Payload ID: 14300
  Gene Symbol: RESP18
  Gene Name: regulated endocrine-specific protein 18
  ENSP ID: ENSP00000375933
MIQKMEHASRLHPQEPCLKDGKALFPTKTTEQEEKLQLLFPSETHSPLAKVNRDQCFTSEVVSKALKQEVANPVKGFSGPLPTVGRNPVAD

SEQ ID NO: 72219 - protein, 1541 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000264839
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72220 - protein, 740 aa, Homo sapiens
  Payload ID: 14301
  Gene Symbol: RIMS1
  Gene Name: regulating synaptic membrane exocytosis 1
  ENSP ID: ENSP00000359448
RPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72221 - protein, 1012 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000385649
MCAPGIHVSSEGWEEVRSVDSEEGTIEARRAVAGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72222 - protein, 753 aa, Homo sapiens
  Payload ID: 14301
  Gene Symbol: RIMS1
  Gene Name: regulating synaptic membrane exocytosis 1
  ENSP ID: ENSP00000389503
MPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACI

SEQ ID NO: 72223 - protein, 219 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000402273
MAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72224 - protein, 760 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000411235
MPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72225 - protein, 817 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000428328
MCAPGIHVSSEGWEEVRSVDSEEGTIEARRAVAGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72226 - protein, 826 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000428367
MFAGFLQFLLLHTLHSGTGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERHSRKSERSSIQKQTRKGTASDAERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72227 - protein, 1692 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000428417
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSSILPAHTKTKSVTRQDISLHHECFNSTVLRFTDEILVSELQPFLDRARSASTNCLRPDTSLHSPERERGRWSPSLDRRRPPSPRIQIQHASPENDRHSRKSERSSIQKQTRKGTASDAERVLPTCLSRRGHAAPRATDQPVIRGKHPARSRSSEHSSIRTLCSMHHLVPGGSAPPSPLLTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72228 - protein, 610 aa, Homo sapiens
  Payload ID: 14301
  Gene Symbol: RIMS1
  Gene Name: regulating synaptic membrane exocytosis 1
  ENSP ID: ENSP00000429338
  MOD_RES (1)..(1): Any amino acid
XDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHSRKSERSSIQKQTRKGTASDAERMHRQRSPTQSPPADTSFSSRRGRQLPQVPVRSGSIEQEQEKYNSSTKASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72229 - protein, 1475 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000429959
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRIRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72230 - protein, 1481 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000430101
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72231 - protein, 1038 aa, Homo sapiens
  Payload ID: 14301
  Gene Symbol: RIMS1
  Gene Name: regulating synaptic membrane exocytosis 1
  ENSP ID: ENSP00000430359
  MOD_RES (1)..(1): Any amino acid
XYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72232 - protein, 1371 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000430408
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERGRWSPSLDRRRPPSPRIQIQHASPENDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72233 - protein, 1342 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000430502
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTSELQPFLDRARSASTNCLRPDTSLHSPERERMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72234 - protein, 1291 aa, Homo sapiens
  Payload ID: 14301
  Gene Symbol: RIMS1
  Gene Name: regulating synaptic membrane exocytosis 1
  Uniprot ID: Q86UR5
  ENSP ID: ENSP00000430932
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRVILNKRTTMPKDSGALLGLKVVGGKMTDLGRLGAFITKVKKGSLADVVGHLRAGDEVLEWNGKPLPGATNEEVYNIILESKSEPQVEIIVSRPIGDIPRIPESSHPPLESSSSSFESQKMERPSISVISPTSPGALKDAPQVLPGQLSVKLWYDKVGHQLIVNVLQATDLPARVDGRPRNPYVKMYFLPDRSDKSKRRTKTVKKILEPKWNQTFVYSHVHRRDFRERMLEITVWDQPRVQEEESEFLGEILIELETALLDDEPHWYKLQTHDESSLPLPQPSPFMPRRHIHGESSSKKLQRSQRISDSDISDYEVDDGIGVVPPGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDRMHRQRSPTQSPPADTSFSSRRGRQLPQVPVRSGSIEQESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 72235 - protein, 1188 aa, Homo sapiens
  Payload ID: 14302
  Gene Symbol: RIMS2
  Gene Name: regulating synaptic membrane exocytosis 2
  Uniprot ID: Q9UQ26
  ENSP ID: ENSP00000262231
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDSQKGKRKTSEQAVLSDSNTRSERQKEMMYFGGHSLEEDLEWSEPQIKDSGVDTCSSTTLNEEHSHSDKHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 72236 - protein, 285 aa, Homo sapiens
  Payload ID: 14302
  Gene Symbol: RIMS2
  Gene Name: regulating synaptic membrane exocytosis 2
  Uniprot ID: Q9UQ26
  ENSP ID: ENSP00000342051
MGRQGLGGASAAGRSMQRSQSRSSLSASFEALAGYFPCMNSLEEEEGEAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 72237 - protein, 470 aa, Homo sapiens
  Payload ID: 14302
  Gene Symbol: RIMS2
  Gene Name: regulating synaptic membrane exocytosis 2
  ENSP ID: ENSP00000384892
MPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDSFYFCYLSHESWNVEGCPTVLIRTTFKPKP

SEQ ID NO: 72238 - protein, 1253 aa, Homo sapiens
  Payload ID: 14302
  Gene Symbol: RIMS2
  Gene Name: regulating synaptic membrane exocytosis 2
  ENSP ID: ENSP00000386228
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDSHFLTLPRSRYSQTIDHHHRDGRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRNNGVKEIEPYEELDSTRRRYAGTMDIEERNRQMKINKYKQVAGSDPRLEQDYHSKYRSGWDPHRGADNVSTKSSDSDVSDISAVSRTSSASRFSSTSYMSVQSERPGGNKKISVFTSKMQSRQMGISGKNMTKSTSISGDMCSLEKNDGSQSDTAVGTLGTSGKKRRSSLGAKMVAIVGLSRKSRSASQLSQTEAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIA

SEQ ID NO: 72239 - protein, 1367 aa, Homo sapiens
  Payload ID: 14302
  Gene Symbol: RIMS2
  Gene Name: regulating synaptic membrane exocytosis 2
  ENSP ID: ENSP00000390665
MLDRCALVEQRKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSSQSLSRRTTPFVPRVQIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDSHFLTLPRSRYSQTIDHHHRDGRSHPRTGSVQTSPSSTPVAGRRGRQLPQLPPKGTLDRNNGVKEIEPYEEELDSTRRRYAGTMDIEERNRQMKINKYKQVAGSDPRLEQDYHSKYRSGWDPHRGADNVSTKSSDSDVSDISAVSRTSSASRFSSTSYMSVQSERPGGNKKIRPKGIEEGGKEGDKHEEIVHEKEEVKEERINENEKGKEIAKTCNKEKNRESGDEEKTQDIHEQGKEKEQWNKEDLQRRFSQDDTSVFTSKMQSRQMGISGKNMTKSTSISGDMCSLEKNDGSQSDTAVGTLGTSGKKRRSSLGAKMVAIVGLSRKSRSASQLSQTEAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 72240 - protein, 1163 aa, Homo sapiens
  Payload ID: 14302
  Gene Symbol: RIMS2
  Gene Name: regulating synaptic membrane exocytosis 2
  Uniprot ID: Q9UQ26
  ENSP ID: ENSP00000423559
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDSHFLTLPRSRYSQTIDHHHRDGRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 72241 - protein, 665 aa, Homo sapiens
  Payload ID: 14302
  Gene Symbol: RIMS2
  Gene Name: regulating synaptic membrane exocytosis 2
  ENSP ID: ENSP00000425205
MQFETLRQVCNSVLSHFHGVFSSPPNILQNELFGQTLNNARKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDV

SEQ ID NO: 72242 - protein, 1349 aa, Homo sapiens
  Payload ID: 14302
  Gene Symbol: RIMS2
  Gene Name: regulating synaptic membrane exocytosis 2
  Uniprot ID: Q9UQ26
  ENSP ID: ENSP00000427018
MSAPVGPRGRLAPIPAASQPPLQPEMPDLSHLTEEERKIILAVMDRQKKEEEKEQSVLKKLHQQFEMYKEQVKKMGEESQQQQEQKGDAPTCGICHKTKFADGCGHNCSYCQTKFCARCGGRVSLRSNKVMWVCNLCRKQQEILTKSGAWFYNSGSNTPQQPDQKVLRGLRNEEAPQEKKPKLHEQTQFQGPSGDLSVPAVEKSRSHGLTRQHSIKNGSGVKHHIASDIASDRKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSSQSLSRRTTPFVPRVQIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRKAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLVDPTLAPLTRRASQSSLESSTGPSYSRS

SEQ ID NO: 72243 - protein, 258 aa, Homo sapiens
  Payload ID: 14302
  Gene Symbol: RIMS2
  Gene Name: regulating synaptic membrane exocytosis 2
  ENSP ID: ENSP00000428478
MGRQGLGGASAAGRSMQRSQSRSSLSASFEALAGYFPCMNSLEEEEGEAGGKKLRSTVQRSTETGLAVEMRNWMTRQASRESTDGSMNSYSSEGNLIFPGVRLASDSQFSDFLDGLGPAQLVGRQTLATPAMGDIQVGMMDKKGQLEVEIIRARGLVVKPGSKTLPAPYVKVYLLDNGVCIAKKKTKVARKTLEPLYQQLLSFEESPQGKVLQIIVWGDYGRMDHKSFMGVAQILLDELELSNMVIGWFKLFPPSSLV

SEQ ID NO: 72244 - protein, 1060 aa, Homo sapiens
  Payload ID: 14302
  Gene Symbol: RIMS2
  Gene Name: regulating synaptic membrane exocytosis 2
  ENSP ID: ENSP00000487079
RKLHQQFEMYKEQVKKMGEESQQQQEQKGDAPTCGICHKTKFADGCGHNCSYCQTKFCARCGGRVSLRSNKVMWVCNLCRKQQEILTKSGAWFYNSGSNTPQQPDQKVLRGLRNEEAPQEKKPKLHEQTQFQGPSGDLSVPAVEKSRSHGLTRQHSIKNGSGVKHHIASDIASDRKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSSQSLSRRTTPFVPRVQIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRNNGVKEI

SEQ ID NO: 72245 - protein, 1121 aa, Homo sapiens
  Payload ID: 14302
  Gene Symbol: RIMS2
  Gene Name: regulating synaptic membrane exocytosis 2
  ENSP ID: ENSP00000487907
MSAPVGPRGRLAPIPAASQPPLQPEMPDLSHLTEEERKIILAVMDRQKKEEEKEQSVLKKLHQQFEMYKEQVKKMGEESQQQQEQKGDAPTCGICHKTKFADGCGHNCSYCQTKFCARCGGRVSLRSNKEDKVVMWVCNLCRKQQEILTKSGAWFYNSGSNTPQQPDQKVLRGLRNEEAPQEKKPKLHEQTQFQGPSGDLSVPAVEKSRSHGLTRQHSIKNGSGVKHHIASDIASDRKRSPSVSRDQNRRYDQREEREEYSQYATSDTAMPRSPSDYADRRSQHEPQFYEDSDHLSYRDSNRRSHRHSKEYIVDDEDVESRDEYERQRREEEYQSRYRSDPNLARYPVKPQPYEEQMRIHAEVSRARHERRHSDVSLANADLEDSRISMLRMDRPSRQRSISERRAAMENQRSYSMERTREAQGPSSYAQRTTNHSPPTPRRSPLPIDRPDLRRTDSLRKQHHLDPSSAVRKTKREKMETMLRNDSLSSDQSESVRPPPPKPHKSKKGGKMRQISLSSSEEELASTPEYTSCDDVEIESESVSEKGDMDYNWLDHTSWHSSEASPMSLHPVTWQPSKDGDRLIGRILLNKRLKDGSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQSRNVEQGLRGTRTMTGHYNTISRMDRHRVMDDHYSPDRDSHFLTLPRSRYSQTIDHHHRDGRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDR

SEQ ID NO: 72246 - protein, 370 aa, Homo sapiens
  Payload ID: 14302
  Gene Symbol: RIMS2
  Gene Name: regulating synaptic membrane exocytosis 2
  ENSP ID: ENSP00000488393
  MOD_RES (1)..(1): Any amino acid
XSVPRDSGAMLGLKVVGGKMTESGRLCAFITKVKKGSLADTVGHLRPGDEVLEWNGRLLQGATFEEVYNIILESKPEPQVELVVSRPIGDIPRIPDSTHAQLESSSSSFESQKMDRPSISVTSPMSPGMLRDVPQFLSGQLSIKLWFDKVGHQLIVTILGAKDLPSREDGRPRNPYVKIYFLPDRSDKNKRRTKTVKKTLEPKWNQTFIYSPVHRREFRERMLEITLWDQARVREEESEFLGEILIELETALLDDEPHWYKLQTHDVSSLPLPHPSPYMPRRQLHGESPTRRLQRSKRISDSEVSDYDCDDGIGVVSDYRHDGRDLQSSTLSVPEQVMSSNHCSPSGSPHRVDVIGRTRSWSPSVPPPQR

SEQ ID NO: 72247 - protein, 308 aa, Homo sapiens
  Payload ID: 14303
  Gene Symbol: RIMS3
  Gene Name: regulating synaptic membrane exocytosis 3
  Uniprot ID: Q9UJD0
  ENSP ID: ENSP00000361768
MFNGEPGPASSGASRNVVRSSSISGEICGSQQAGGGAGTTTAKKRRSSLGAKMVAIVGLTQWSKSTLQLPQPEGATKKLRSNIRRSTETGIAVEMRSRVTRQGSRESTDGSTNSNSSDGTFIFPTTRLGAESQFSDFLDGLGPAQIVGRQTLATPPMGDVHIAIMDRSGQLEVEVIEARGLTPKPGSKSLPATYIKVYLLENGACLAKKKTKMTKKTCDPLYQQALLFDEGPQGKVLQVIVWGDYGRMDHKCFMGMAQIMLDELDLSAAVTGWYKLFPTSSVADSTLGSLTRRLSQSSLESATSPSCS

SEQ ID NO: 72248 - protein, 308 aa, Homo sapiens; identical to SEQ ID NO: 72247
  Payload ID: 14303
  Gene Symbol: RIMS3
  Gene Name: regulating synaptic membrane exocytosis 3
  Uniprot ID: Q9UJD0
  ENSP ID: ENSP00000361769

SEQ ID NO: 72249 - protein, 269 aa, Homo sapiens
  Payload ID: 14304
  Gene Symbol: RIMS4
  Gene Name: regulating synaptic membrane exocytosis 4
  Uniprot ID: Q9H426
  ENSP ID: ENSP00000361942
MERSQSRLSLSASFEALAIYFPCMNSFDDEDAGDSRRLKGAIQRSTETGLAVEMPSRTLRQASHESIEDSMNSYGSEGNLNYGGVCLASDAQFSDFLGSMGPAQFVGRQTLATTPMGDVEIGLQERNGQLEVDIIQARGLTAKPGSKTLPAAYIKAYLLENGICIAKKKTKVARKSLDPLYNQVLLFPESPQGKVLQVIVWGNYGRMERKQFMGVARVLLEELDLTTLAVGWYKLFPTSSMVDPATGPLLRQASQLSLESTVGPCGERS

SEQ ID NO: 72250 - protein, 270 aa, Homo sapiens
  Payload ID: 14304
  Gene Symbol: RIMS4
  Gene Name: regulating synaptic membrane exocytosis 4
  Uniprot ID: Q9H426
  ENSP ID: ENSP00000439287
MERSQSRLSLSASFEALAIYFPCMNSFDDEDAEGDSRRLKGAIQRSTETGLAVEMPSRTLRQASHESIEDSMNSYGSEGNLNYGGVCLASDAQFSDFLGSMGPAQFVGRQTLATTPMGDVEIGLQERNGQLEVDIIQARGLTAKPGSKTLPAAYIKAYLLENGICIAKKKTKVARKSLDPLYNQVLLFPESPQGKVLQVIVWGNYGRMERKQFMGVARVLLEELDLTTLAVGWYKLFPTSSMVDPATGPLLRQASQLSLESTVGPCGERS

SEQ ID NO: 72251 - protein, 312 aa, Homo sapiens
  Payload ID: 14305
  Gene Symbol: RPRD1A
  Gene Name: regulation of nuclear pre-mRNA domain containing 1A
  Uniprot ID: Q96P16
  ENSP ID: ENSP00000349955
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 72252 - protein, 312 aa, Homo sapiens; identical to SEQ ID NO: 72251
  Payload ID: 14305
  Gene Symbol: RPRD1A
  Gene Name: regulation of nuclear pre-mRNA domain containing 1A
  Uniprot ID: Q96P16
  ENSP ID: ENSP00000381984

SEQ ID NO: 72253 - protein, 276 aa, Homo sapiens
  Payload ID: 14305
  Gene Symbol: RPRD1A
  Gene Name: regulation of nuclear pre-mRNA domain containing 1A
  Uniprot ID: Q96P16
  ENSP ID: ENSP00000465444
MRNSNWRFCQTGIYSKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 72254 - protein, 123 aa, Homo sapiens
  Payload ID: 14305
  Gene Symbol: RPRD1A
  Gene Name: regulation of nuclear pre-mRNA domain containing 1A
  ENSP ID: ENSP00000467268
  MOD_RES (1)..(1): Any amino acid
XENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEVRNLFLL

SEQ ID NO: 72255 - protein, 73 aa, Homo sapiens
  Payload ID: 14305
  Gene Symbol: RPRD1A
  Gene Name: regulation of nuclear pre-mRNA domain containing 1A
  ENSP ID: ENSP00000467949
MSAFSEAALEKKLSELSNSQQSVQTLSLWLIHHRKHSRPIVTVWERELRKERVSVWRDKLQGLCEDQNGIQFS

SEQ ID NO: 72256 - protein, 276 aa, Homo sapiens; identical to SEQ ID NO: 72253
  Payload ID: 14305
  Gene Symbol: RPRD1A
  Gene Name: regulation of nuclear pre-mRNA domain containing 1A
  Uniprot ID: Q96P16
  ENSP ID: ENSP00000467991

SEQ ID NO: 72257 - protein, 49 aa, Homo sapiens
  Payload ID: 14305
  Gene Symbol: RPRD1A
  Gene Name: regulation of nuclear pre-mRNA domain containing 1A
  ENSP ID: ENSP00000468108
EYKRKLARVSLVRKELRSRIQSLPDLSRLPNVTGSHMHLPFAGDIYSED

SEQ ID NO: 72258 - protein, 4 aa, Homo sapiens
  Payload ID: 14305
  Gene Symbol: RPRD1A
  Gene Name: regulation of nuclear pre-mRNA domain containing 1A
  ENSP ID: ENSP00000468173
  MOD_RES (1)..(1): Any amino acid
XSED

SEQ ID NO: 72259 - protein, 289 aa, Homo sapiens
  Payload ID: 14305
  Gene Symbol: RPRD1A
  Gene Name: regulation of nuclear pre-mRNA domain containing 1A
  ENSP ID: ENSP00000468209
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEILDMGVSSNDVVTISIFFLLKINIKP

SEQ ID NO: 72260 - protein, 326 aa, Homo sapiens
  Payload ID: 14306
  Gene Symbol: RPRD1B
  Gene Name: regulation of nuclear pre-mRNA domain containing 1B
  Uniprot ID: Q9NQG5
  ENSP ID: ENSP00000362532
MSSFSESALEKKLSELSNSQQSVQTLSLWLIHHRKHAGPIVSVWHRELRKAKSNRKLTFLYLANDVIQNSKRKGPEFTREFESVLVDAFSHVAREADEGCKKPLERLLNIWQERSVYGGEFIQQLKLSMEDSKSPPPKATEEKKSLKRTFQQIQEEEDDDYPGSYSPQDPSAGPLLTEELIKALQDLENAASGDATVRQKIASLPQEVQDVSLLEKITDKEAAERLSKTVDEACLLLAEYNGRLAAELEDRRQLARMLVEYTQNQKDVLSEKEKKLEEYKQKLARVTQVRKELKSHIQSLPDLSLLPNVTGGLAPLPSAGDLFSTD

SEQ ID NO: 72261 - protein, 197 aa, Homo sapiens
  Payload ID: 14306
  Gene Symbol: RPRD1B
  Gene Name: regulation of nuclear pre-mRNA domain containing 1B
  ENSP ID: ENSP00000416420
MFLSYRSDLPAYMFPGGSSPTTEEKKSLKRTFQQIQEEEDDDYPGSYSPQDPSAGPLLTEELIKALQDLENAASGDATVRQKIASLPQEVQDVSLLEKITDKEAAERLSKTVDEACLLLAEYNGRLAAELEDRRQLARMLVEYTQNQKDVLSEKEKKLEEYKQKLARVTQVRKELKSHIQSLPDLSLLPNVTGGLAP

SEQ ID NO: 72262 - protein, 113 aa, Homo sapiens
  Payload ID: 14306
  Gene Symbol: RPRD1B
  Gene Name: regulation of nuclear pre-mRNA domain containing 1B
  ENSP ID: ENSP00000433947
MSSFSESALEKKLSELSNSQQSVQTLSLWLIHHRKHAGPIVSVWHRELRKAKSNRKLTFLYLANDVIQNSKRKGPEFTREFESVLVDAFSHVASNRREEISETNFSANSGGGG

SEQ ID NO: 72263 - protein, 60 aa, Homo sapiens
  Payload ID: 14306
  Gene Symbol: RPRD1B
  Gene Name: regulation of nuclear pre-mRNA domain containing 1B
  ENSP ID: ENSP00000436816
MSSFSESALEKKLSELSNSQQSVQTLSLWLIHHRKHAGPIVSVWHRELRKERQMKAVKNL

SEQ ID NO: 72264 - protein, 34 aa, Homo sapiens
  Payload ID: 14306
  Gene Symbol: RPRD1B
  Gene Name: regulation of nuclear pre-mRNA domain containing 1B
  ENSP ID: ENSP00000478724
  MOD_RES (1)..(1): Any amino acid
XQLARMLVEYTQNQKDVLSEKEKKLEGVMIDFGL

SEQ ID NO: 72265 - protein, 63 aa, Homo sapiens
  Payload ID: 14306
  Gene Symbol: RPRD1B
  Gene Name: regulation of nuclear pre-mRNA domain containing 1B
  ENSP ID: ENSP00000484897
  MOD_RES (1)..(1): Any amino acid
XKEAAERLSKTVDEACLLLAEYNGRLAAELEDRRQLARMLVEYTQNQKDVLSEKEKKLELVTH

SEQ ID NO: 72266 - protein, 152 aa, Homo sapiens
  Payload ID: 14307
  Gene Symbol: RPRD2
  Gene Name: regulation of nuclear pre-mRNA domain containing 2
  Uniprot ID: Q5VT52
  ENSP ID: ENSP00000358063
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSKCLFLS

SEQ ID NO: 72267 - protein, 1461 aa, Homo sapiens
  Payload ID: 14307
  Gene Symbol: RPRD2
  Gene Name: regulation of nuclear pre-mRNA domain containing 2
  Uniprot ID: Q5VT52
  ENSP ID: ENSP00000358064
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALSTTFKTQKQLKENLNKQPNKQWKKSQTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTMESEKSATPEPVTDNRDVEDMELSDVEDDGSKIIVEDRKEKPAEKSAVSTSVPTKPTENISKASSCTPVPVTMTATPPLPKPVNTSLSPSPALALPNLANVDLAKISSILSSLTSVMKNTGVSPASRPSPGTPTSPSNLTSGLKTPAPATTTSHNPLANILSKVEITPESILSALSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPPPPGEHSGIPFPTPPPPPPPGEHSSSGGSGVPFSTPPPPPPPVDHSGVVPFPAPPLAEHGVAGAVAVFPKDHSSLLQGTLAEHFGVLPGPRDHGGPTQRDLNGPGLSRVRESLTLPSHSLEHLGPPHGGGGGGGSNSSSGPPLGPSHRDTISRSGIILRSPRPDFRPREPFLSRDPFHSLKRPRPPFARGPPFFAPKRPFFPPRY

SEQ ID NO: 72268 - protein, 1435 aa, Homo sapiens
  Payload ID: 14307
  Gene Symbol: RPRD2
  Gene Name: regulation of nuclear pre-mRNA domain containing 2
  Uniprot ID: Q5VT52
  ENSP ID: ENSP00000383785
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVLPEAAALVKDPSVSKSVERIFKIWEDRNVYPEEMIVALREALTSTNPKAALKSKIVAEFRSQALIEELLLYKRSEDQIELKEKQLSTMRVDVCSTETLKCLKDKTGGKKFSKEFEEASSKLEEFVNGLDKQVKNGPSLTEALENAGIFYEAQYKEVKVVANAYKTFANRVNNLKKKLDQLKSTLPDPEESPVPSPSMDAPSPTGSESPFQGMGGEESQSPTMESEKSATPEPVTDNRDVEDMELSDVEDDGSKIIVEDRKEKPAEKSAVSTSVPTKPTENISKASSCTPVPVTMTATPPLPKPVNTSLSPSPALALPNLANVDLAKISSILSSLTSVMKNTGVSPASRPSPGTPTSPSNLTSGLKTPAPATTTSHNPLANILSKVEITPESILSALSKTQTQSAPALQGLSSLLQSVTGNPVPASEAASQSTSASPANTTVSTIKGRNLPSSAQPFIPKSFNYSPNSSTSEVSSTSASKASIGQSPGLPSTTFKLPSNSLGFTATHNTSPAAPPTEVTICQSSEVSKPKLESESTSPSLEMKIHNFLKGNPGFSGLNLNIPILSSLGSSAPSESHPSDFQRGPTSTSIDNIDGTPVRDERSGTPTQDEMMDKPTSSSVDTMSLLSKIISPGSSTPSSTRSPPPGRDESYPRELSNSVSTYRPFGLGSESPYKQPSDGMERPSSLMDSSQEKFYPDTSFQEDEDYRDFEYSGPPPSAMMNLEKKPAKSILKSSKLSDTTEYQPILSSYSHRAQEFGVKSAFPPSVRALLDSSENCDRLSSSPGLFGAFSVRGNEPGSDRSPSPSKNDSFFTPDSNHNSLSQSTTGHLSLPQKQYPDSPHPVPHRSLFSPQNTLAAPTGHPPTSGVEKVLASTISTTSTIEFKNMLKNASRKPSDDKHFGQAPSKGTPSDGVSLSNLTQPSLTATDQQQQEEHYRIETRVSSSCLDLPDSTEEKGAPIETLGYHSASNRRMSGEPIQTVESIRVPGKGNRGHGREASRVGWFDLSTSGSSFDNGPSSASELASLGGGGSGGLTGFKTAPYKERAPQFQESVGSFRSNSFNSTFEHHLPPSPLEHGTPFQREPVGPSSAPPVPPKDHGGIFSRDAPTHLPSVDLSNPFTKEAALAHAAPPPPPGEHSGIPFPTPPPPPPPGEHSSSGGSGVPFSTPPPPPPPVDHSGVVPFPAPPLAEHGVAGAVAVFPKDHSSLLQGTLAEHFGVLPGPRDHGGPTQRDLNGPGLSRVRESLTLPSHSLEHLGPPHGGGGGGGSNSSSGPPLGPSHRDTISRSGIILRSPRPDFRPREPFLSRDPFHSLKRPRPPFARGPPFFAPKRPFFPPRY

SEQ ID NO: 72269 - protein, 252 aa, Homo sapiens
  Payload ID: 14308
  Gene Symbol: RCAN1
  Gene Name: regulator of calcineurin 1
  Uniprot ID: P53805
  ENSP ID: ENSP00000320768
MEDGVAGPQLGAAAEAAEAAEARARPGVTLRPFAPLSGAAEADEGGGDWSFIDCEMEEVDLQDLPSATIACHLDPRVFVDGLCRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 72270 - protein, 197 aa, Homo sapiens
  Payload ID: 14308
  Gene Symbol: RCAN1
  Gene Name: regulator of calcineurin 1
  Uniprot ID: P53805
  ENSP ID: ENSP00000370524
MHFRNFNYSFSSLIACVANSDIFSESETRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 72271 - protein, 277 aa, Homo sapiens
  Payload ID: 14308
  Gene Symbol: RCAN1
  Gene Name: regulator of calcineurin 1
  ENSP ID: ENSP00000370527
MNSTVRQLRVPSHVPLRDPSWESLRNVPKLKKSRGMQGEQGRRLFRLLLNDLPGRDRLPCSYPQPHVEQASTSASPRLLAVNIPEDTLLSYPESSLPLQRHCAFHRFSKAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 72272 - protein, 171 aa, Homo sapiens
  Payload ID: 14308
  Gene Symbol: RCAN1
  Gene Name: regulator of calcineurin 1
  Uniprot ID: P53805
  ENSP ID: ENSP00000382214
MVYAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 72273 - protein, 117 aa, Homo sapiens
  Payload ID: 14308
  Gene Symbol: RCAN1
  Gene Name: regulator of calcineurin 1
  Uniprot ID: P53805
  ENSP ID: ENSP00000392438
MKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 72274 - protein, 242 aa, Homo sapiens
  Payload ID: 14308
  Gene Symbol: RCAN1
  Gene Name: regulator of calcineurin 1
  ENSP ID: ENSP00000417926
MQGEQGRRLFRLLLNDLPGRDRLPCSYPQPHVEQASTSASPRLLAVNIPEDTLLSYPESSLPLQRHCAFHRFSKAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 72275 - protein, 117 aa, Homo sapiens; identical to SEQ ID NO: 72273
  Payload ID: 14308
  Gene Symbol: RCAN1
  Gene Name: regulator of calcineurin 1
  Uniprot ID: P53805
  ENSP ID: ENSP00000419252

SEQ ID NO: 72276 - protein, 117 aa, Homo sapiens; identical to SEQ ID NO: 72273
  Payload ID: 14308
  Gene Symbol: RCAN1
  Gene Name: regulator of calcineurin 1
  Uniprot ID: P53805
  ENSP ID: ENSP00000419624

SEQ ID NO: 72277 - protein, 205 aa, Homo sapiens
  Payload ID: 14308
  Gene Symbol: RCAN1
  Gene Name: regulator of calcineurin 1
  ENSP ID: ENSP00000477155
MHFRNFNYSFSSLIACVANSDIFSESETRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEQGPRVGGRQGETQLLPCTREQYHHYPRSSPEPMPACFVSFSVFFCATVPCAGSMPASWHHLQC

SEQ ID NO: 72278 - protein, 117 aa, Homo sapiens; identical to SEQ ID NO: 72273
  Payload ID: 14308
  Gene Symbol: RCAN1
  Gene Name: regulator of calcineurin 1
  Uniprot ID: P53805
  ENSP ID: ENSP00000477646

SEQ ID NO: 72279 - protein, 243 aa, Homo sapiens
  Payload ID: 14309
  Gene Symbol: RCAN2
  Gene Name: regulator of calcineurin 2
  Uniprot ID: Q14206
  ENSP ID: ENSP00000305223
MRGESYFIGMRSPGQQGHVPEDGGLFLLCCIDRDWAVTRCFAEEAFQAITDFNDLPNSLFACNVHQSVFEGEESKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQTRRPGLPPSVSN

SEQ ID NO: 72280 - protein, 197 aa, Homo sapiens [sequence omitted]

SEQ ID NO: 72281 - protein, 243 aa, Homo sapiens; identical to SEQ ID NO: 72279
  Payload ID: 14309
  Gene Symbol: RCAN2
  Gene Name: regulator of calcineurin 2
  Uniprot ID: Q14206
  ENSP ID: ENSP00000360425

SEQ ID NO: 72282 - protein, 224 aa, Homo sapiens
  Payload ID: 14309
  Gene Symbol: RCAN2
  Gene Name: regulator of calcineurin 2
  ENSP ID: ENSP00000384317
MPAPSMDCDVSTLVACVVDVEVFTNQEVKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQTRRPGLPPSVSNAACSFSIIAVSSLSCFFPLLFVKKNCL

SEQ ID NO: 72283 - protein, 137 aa, Homo sapiens
  Payload ID: 14310
  Gene Symbol: RGCC
  Gene Name: regulator of cell cycle
  Uniprot ID: Q9H4X1
  ENSP ID: ENSP00000368664
MKPPAAQGSPAAAAAAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 72284 - protein, 531 aa, Homo sapiens
  Payload ID: 14311
  Gene Symbol: RCBTB1
  Gene Name: regulator of chromosome condensation (RCC1) and BTB (POZ) domain containing protein 1
  Uniprot ID: Q8NDN9
  ENSP ID: ENSP00000258646
MVDVGKWPIFTLLSPQEIASIRKACVFGTSASEALYVTDNDEVFVFGLNYSNCLGTGDNQSTLVPKKLEGLCGKKIKSLSYGSGPHVLLSTEDGVVYAWGHNGYSQLGNGTTNQGIAPVQVCTNLLIKQVVEVACGSHHSMALAADGEVFAWGYNNCGQVGSGSTANQPTPRKVTNCLHIKRVVGIACGQTSSMAVLDNGEVYGWGYNGNGQLGLGNNGNQLTPVRVAALHSVCVNQIVCGYAHTLALTDEGLLYAWGANTYGQLGTGNKNNLLSPAHIMVEKERVVEIAACHSAHTSAAKTQGGHVYMWGQCRGQSVILPHLTHFSCTDDVFACFATPAVSWRLLSVEHEDFLTVAESLKKEFDSPETADLKFRIDGKYIHVHKAVLKIRCEHFRSMFQSYWNEDMKEVIEIDQFSYPVYRAFLQYLYTDTVDLPPEDAIGLLDLATSYCENRLKKLCQHIIKRGITVENAFSLFSAAVRYDAEDLEEFCFKFCINHLTEVTQTAAFWQMDGPLLKEFIAKASKCGAFKN

SEQ ID NO: 72285 - protein, 531 aa, Homo sapiens; identical to SEQ ID NO: 72284
  Payload ID: 14311
  Gene Symbol: RCBTB1
  Gene Name: regulator of chromosome condensation (RCC1) and BTB (POZ) domain containing protein 1
  Uniprot ID: Q8NDN9
  ENSP ID: ENSP00000367552

SEQ ID NO: 72286 - protein, 551 aa, Homo sapiens
  Payload ID: 14312
  Gene Symbol: RCBTB2
  Gene Name: regulator of chromosome condensation (RCC1) and BTB (POZ) domain containing protein 2
  Uniprot ID: O95199
  ENSP ID: ENSP00000345144
MEEELPLFSGDSGKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 72287 - protein, 556 aa, Homo sapiens
  Payload ID: 14312
  Gene Symbol: RCBTB2
  Gene Name: regulator of chromosome condensation (RCC1) and BTB (POZ) domain containing protein 2
  ENSP ID: ENSP00000389910
MSALPRDLELSNPREKLTKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 72288 - protein, 277 aa, Homo sapiens
  Payload ID: 14312
  Gene Symbol: RCBTB2
  Gene Name: regulator of chromosome condensation (RCC1) and BTB (POZ) domain containing protein 2
  ENSP ID: ENSP00000443862
MSGVTTETGSLDSATVATSQPLAEWQLCKASVSRGIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 72289 - protein, 527 aa, Homo sapiens
  Payload ID: 14312
  Gene Symbol: RCBTB2
  Gene Name: regulator of chromosome condensation (RCC1) and BTB (POZ) domain containing protein 2
  Uniprot ID: O95199
  ENSP ID: ENSP00000443904
MLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 72290 - protein, 452 aa, Homo sapiens
  Payload ID: 14313
  Gene Symbol: RCC1
  Gene Name: regulator of chromosome condensation 1
  Uniprot ID: P18754
  ENSP ID: ENSP00000362937
MSPKRIAKRRSPPADAIPKSKKVKDTRAAASRRVPGARSCQGACGPSPPDQKTRPVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 72291 - protein, 421 aa, Homo sapiens
  Payload ID: 14313
  Gene Symbol: RCC1
  Gene Name: regulator of chromosome condensation 1
  Uniprot ID: P18754
  ENSP ID: ENSP00000362938
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 72292 - protein, 421 aa, Homo sapiens; identical to SEQ ID NO: 72291
  Payload ID: 14313
  Gene Symbol: RCC1
  Gene Name: regulator of chromosome condensation 1
  Uniprot ID: P18754
  ENSP ID: ENSP00000362939

SEQ ID NO: 72293 - protein, 421 aa, Homo sapiens; identical to SEQ ID NO: 72291
  Payload ID: 14313
  Gene Symbol: RCC1
  Gene Name: regulator of chromosome condensation 1
  Uniprot ID: P18754
  ENSP ID: ENSP00000381931

SEQ ID NO: 72294 - protein, 283 aa, Homo sapiens
  Payload ID: 14313
  Gene Symbol: RCC1
  Gene Name: regulator of chromosome condensation 1
  ENSP ID: ENSP00000394650
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIP

SEQ ID NO: 72295 - protein, 272 aa, Homo sapiens
  Payload ID: 14313
  Gene Symbol: RCC1
  Gene Name: regulator of chromosome condensation 1
  ENSP ID: ENSP00000402260
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQL

SEQ ID NO: 72296 - protein, 230 aa, Homo sapiens
  Payload ID: 14313
  Gene Symbol: RCC1
  Gene Name: regulator of chromosome condensation 1
  ENSP ID: ENSP00000402740
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVM

SEQ ID NO: 72297 - protein, 272 aa, Homo sapiens
  Payload ID: 14313
  Gene Symbol: RCC1
  Gene Name: regulator of chromosome condensation 1
  ENSP ID: ENSP00000405258
MMEAEDRKMSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRHCLFHTSQRLGWGKEVWRQGLSHLRVSKDNNGVIGLLEPMKKSMVPVQVQLDVPVVKVASGNDHLVMLTADGDLYTLGCGEQGQLGRVPELFANRGGRQGLERLLVPKCVMLKSRGS

SEQ ID NO: 72298 - protein, 372 aa, Homo sapiens
  Payload ID: 14313
  Gene Symbol: RCC1
  Gene Name: regulator of chromosome condensation 1
  ENSP ID: ENSP00000413644
MSPKRIAKRRSPPADAIPKSKKVKDTRAAASRRVPGARSCQVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGAS

SEQ ID NO: 72299 - protein, 148 aa, Homo sapiens
  Payload ID: 14313
  Gene Symbol: RCC1
  Gene Name: regulator of chromosome condensation 1
  ENSP ID: ENSP00000472057
MGLCREEDGFVRHALGEGGLQIGEGALPGRGWVVGARGSPAVDLWEPCVLNSAAAQSVSRLFAGHLLRPSLAGLGDSSEKSRPVSLANYALEPRRRTLLDRKMSPKRIAKRRSPPADAIPKSKKVKDTRAAASRRVPGARSCQVSHRS

SEQ ID NO: 72300 - protein, 522 aa, Homo sapiens; identical to SEQ ID NO: 69015
  Payload ID: 14314
  Gene Symbol: RCC2
  Gene Name: regulator of chromosome condensation 2
  Uniprot ID: Q9P258
  ENSP ID: ENSP00000364582

SEQ ID NO: 72301 - protein, 522 aa, Homo sapiens; identical to SEQ ID NO: 69015
  Payload ID: 14314
  Gene Symbol: RCC2
  Gene Name: regulator of chromosome condensation 2
  Uniprot ID: Q9P258
  ENSP ID: ENSP00000364585

SEQ ID NO: 72302 - protein, 235 aa, Homo sapiens
  Payload ID: 14315
  Gene Symbol: RGS9BP
  Gene Name: regulator of G protein signaling 9 binding protein
  Uniprot ID: Q6ZS82
  ENSP ID: ENSP00000334134
MAREECKALLDGLNKTTACYHHLVLTVGGSADSQNLRQELQKTRQKAQELAVSTCARLTAVLRDRGLAADERAEFERLWVAFSGCLDLLEADMRRALELGAAFPLHAPRRPLVRTGVAGASSGVAARALSTRSLRLEAEGDFDVADLRELEREVLQVGEMIDNMEMKVNVPRWTVQARQAAGAELLSTVSAGPSSVVSLQERGGGCDPRKALAAILFGAVLLAAVALAVCVAKLS

SEQ ID NO: 72303 - protein, 209 aa, Homo sapiens
  Payload ID: 14316
  Gene Symbol: RGS1
  Gene Name: regulator of G-protein signaling 1
  Uniprot ID: Q08116
  ENSP ID: ENSP00000356429
MRAAAISTPKLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 72304 - protein, 169 aa, Homo sapiens
  Payload ID: 14316
  Gene Symbol: RGS1
  Gene Name: regulator of G-protein signaling 1
  Uniprot ID: Q08116
  ENSP ID: ENSP00000464323
MRAAAISTPKLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQVSIKLIIISFSIKDPICRNNI

SEQ ID NO: 72305 - protein, 173 aa, Homo sapiens
  Payload ID: 14317
  Gene Symbol: RGS10
  Gene Name: regulator of G-protein signaling 10
  Uniprot ID: O43665
  ENSP ID: ENSP00000358097
MQSELCFADIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 72306 - protein, 181 aa, Homo sapiens
  Payload ID: 14317
  Gene Symbol: RGS10
  Gene Name: regulator of G-protein signaling 10
  Uniprot ID: O43665
  ENSP ID: ENSP00000358099
MFNRAVSRLSRKRPPSDIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 72307 - protein, 167 aa, Homo sapiens
  Payload ID: 14317
  Gene Symbol: RGS10
  Gene Name: regulator of G-protein signaling 10
  Uniprot ID: O43665
  ENSP ID: ENSP00000376605
MEHIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 72308 - protein, 84 aa, Homo sapiens
  Payload ID: 14318
  Gene Symbol: RGS11
  Gene Name: regulator of G-protein signaling 11
  ENSP ID: ENSP00000168869
MERVVVSMQDPDQGVKMRSQRLLVTVIPHAVTGSDVVQWLAQKFCVSEEDPVLLDKYPEAGCRAGLCHLPGQEEHPKTGDPGGL

SEQ ID NO: 72309 - protein, 446 aa, Homo sapiens
  Payload ID: 14318
  Gene Symbol: RGS11
  Gene Name: regulator of G-protein signaling 11
  Uniprot ID: O94810
  ENSP ID: ENSP00000319069
MERVVVSMQDPDQGVKMRSQRLLVTVIPHAVTGSDVVQWLAQKFCVSEEEALHLGAVLVQHGYIYPLRDPRSLMLRPDETPYRFQTPYFWTSTLRPAAELDYAIYLAKKNIRKRGTLVDYEKDCYDRLHKKINHAWDLVLMQAREQLRAAKQRSKGDRLVIACQEQTYWLVNRPPPGAPDVLEQGPGRGSCAASRVLMTKSADFHKREIEYFRKALGRTRVKSSVCLEAYLSFCGQRGPHDPLVSGCLPSNPWISDNDAYWVMNAPTVAAPTKLRVERWGFSFRELLEDPVGRAHFMDFLGKEFSGENLSFWEACEELRYGAQAQVPTLVDAVYEQFLAPGAAHWVNIDSRTMEQTLEGLRQPHRYVLDDAQLHIYMLMKKDSYPRFLKSDMYKALLAEAGIPLEMKRRVFPFTWRPRHSSPSPALLPTPVEPTAACGPGGGDGVA

SEQ ID NO: 72310 - protein, 456 aa, Homo sapiens
  Payload ID: 14318
  Gene Symbol: RGS11
  Gene Name: regulator of G-protein signaling 11
  Uniprot ID: O94810
  ENSP ID: ENSP00000352778
MAAGPAPPPGRPRAQMPHLRKMERVVVSMQDPDQGVKMRSQRLLVTVIPHAVTGSDVVQWLAQKFCVSEEEALHLGAVLVQHGYIYPLRDPRSLMLRPDETPYRFQVRLGGAAIYLAKKNIRKRGTLVDYEKDCYDRLHKKINHAWDLVLMQAREQLRAAKQRSKGDRLVIACQEQTYWLVNRPPPGAPDVLEQGPGRGSCAASRVLMTKSADFHKREIEYFRKALGRTRVKSSVCLEAYLSFCGQRGPHDPLVSGCLPSNPWISDNDAYWVMNAPTVAAPTKLRVERWGFSFRELLEDPVGRAHFMDFLGKEFSGENLSFWEACEELRYGAQAQVPTLVDAVYEQFLAPGAAHWVNIDSRTMEQTLEGLRQPHRYVLDDAQLHIYMLMKKDSYPRFLKSDMYKALLAEAGIPLEMKRRVFPFTWRPRHSSPSPALLPTPVEPTAACGPGGGDGVA

SEQ ID NO: 72311 - protein, 467 aa, Homo sapiens
  Payload ID: 14318
  Gene Symbol: RGS11
  Gene Name: regulator of G-protein signaling 11
  Uniprot ID: O94810
  ENSP ID: ENSP00000380876
MAAGPAPPPGRPRAQMPHLRKMERVVVSMQDPDQGVKMRSQRLLVTVIPHAVTGSDVVQWLAQKFCVSEEEALHLGAVLVQHGYIYPLRDPRSLMLRPDETPYRFQTPYFWTSTLRPAAELDYAIYLAKKNIRKRGTLVDYEKDCYDRLHKKINHAWDLVLMQAREQLRAAKQRSKGDRLVIACQEQTYWLVNRPPPGAPDVLEQGPGRGSCAASRVLMTKSADFHKREIEYFRKALGRTRVKSSVCLEAYLSFCGQRGPHDPLVSGCLPSNPWISDNDAYWVMNAPTVAAPTKLRVERWGFSFRELLEDPVGRAHFMDFLGKEFSGENLSFWEACEELRYGAQAQVPTLVDAVYEQFLAPGAAHWVNIDSRTMEQTLEGLRQPHRYVLDDAQLHIYMLMKKDSYPRFLKSDMYKALLAEAGIPLEMKRRVFPFTWRPRHSSPSPALLPTPVEPTAACGPGGGDGVA

SEQ ID NO: 72312 - protein, 1447 aa, Homo sapiens
  Payload ID: 14319
  Gene Symbol: RGS12
  Gene Name: regulator of G-protein signaling 12
  Uniprot ID: O14924
  ENSP ID: ENSP00000338509
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGSGTHGSRDLPVNRIIDVDLVTGSAPGRDGGIAGAQAGPGRSQASGGPPTSDLPGLGPVPGEPAKPKTSAHHATFV

SEQ ID NO: 72313 - protein, 1447 aa, Homo sapiens; identical to SEQ ID NO: 72312
  Payload ID: 14319
  Gene Symbol: RGS12
  Gene Name: regulator of G-protein signaling 12
  Uniprot ID: O14924
  ENSP ID: ENSP00000339381

SEQ ID NO: 72314 - protein, 799 aa, Homo sapiens
  Payload ID: 14319
  Gene Symbol: RGS12
  Gene Name: regulator of G-protein signaling 12
  Uniprot ID: O14924
  ENSP ID: ENSP00000342133
MNLGKELSNETHVSNDQQSATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGSGTHGSRDLPVNRIIDVDLVTGSAPGRDGGIAGAQAGPGRSQASGGPPTSDLPGLGPVPGEPAKPKTSAHHATFV

SEQ ID NO: 72315 - protein, 1376 aa, Homo sapiens
  Payload ID: 14319
  Gene Symbol: RGS12
  Gene Name: regulator of G-protein signaling 12
  Uniprot ID: O14924
  ENSP ID: ENSP00000372238
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 72316 - protein, 667 aa, Homo sapiens
  Payload ID: 14319
  Gene Symbol: RGS12
  Gene Name: regulator of G-protein signaling 12
  ENSP ID: ENSP00000424251
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLES

SEQ ID NO: 72317 - protein, 159 aa, Homo sapiens
  Payload ID: 14320
  Gene Symbol: RGS13
  Gene Name: regulator of G-protein signaling 13
  Uniprot ID: O14921
  ENSP ID: ENSP00000375853
MSRRNCWICKMCRDESKRPPSNLTLEEVLQWAQSFENLMATKYGPVVYAAYLKMEHSDENIQFWMACETYKKIASRWSRISRAKKLYKIYIQPQSPREINIDSSTRETIIRNIQEPTETCFEEAQKIVYMHMERDSYPRFLKSEMYQKLLKTMQSNNSF

SEQ ID NO: 72318 - protein, 159 aa, Homo sapiens; identical to SEQ ID NO: 72317
  Payload ID: 14320
  Gene Symbol: RGS13
  Gene Name: regulator of G-protein signaling 13
  Uniprot ID: O14921
  ENSP ID: ENSP00000442837

SEQ ID NO: 72319 - protein, 566 aa, Homo sapiens
  Payload ID: 14321
  Gene Symbol: RGS14
  Gene Name: regulator of G-protein signaling 14
  Uniprot ID: O43566
  ENSP ID: ENSP00000386229
MPGKPKHLGVPNGRMVLAVSDGELSSTTGPQGQGEGRGSSLSIHSLPSGPSSPFPTEEQPVASWALSFERLLQDPLGLAYFTEFLKKEFSAENVTFWKACERFQQIPASDTQQLAQEARNIYQEFLSSQALSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 72320 - protein, 437 aa, Homo sapiens
  Payload ID: 14321
  Gene Symbol: RGS14
  Gene Name: regulator of G-protein signaling 14
  ENSP ID: ENSP00000422329
  MOD_RES (1)..(1): Any amino acid
XSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQRLVLDTLPGVKISKARDKSPCRSQGCPPRTQDKATHPPPASPSSLVKVPSSATGKRQTCDIEGLVELLNRVQSSGAHDQRGLLRKEDLVLPEFLQLPAQGPSSEETPPQTKSAAQPIGGSLNSTTDSAL

SEQ ID NO: 72321 - protein, 202 aa, Homo sapiens
  Payload ID: 14322
  Gene Symbol: RGS16
  Gene Name: regulator of G-protein signaling 16
  Uniprot ID: O15492
  ENSP ID: ENSP00000356529
MCRTLAAFPTTCLERAKEFKTRLGIFLHKSELGCDTGSTGKFEWGSKHSKENRNFSEDVLGWRESFDLLLSSKNGVAAFHAFLKTEFSEENLEFWLACEEFKKIRSATKLASRAHQIFEEFICSEAPKEVNIDHETHELTRMNLQTATATCFDAAQGKTRTLMEKDSYPRFLKSPAYRDLAAQASAASATLSSCSLDEPSHT

SEQ ID NO: 72322 - protein, 210 aa, Homo sapiens
  Payload ID: 14323
  Gene Symbol: RGS17
  Gene Name: regulator of G-protein signaling 17
  Uniprot ID: Q9UGC6
  ENSP ID: ENSP00000206262
MRKRQQSQNEGTPAVSQAPGNQRPNNTCCFCWCCCCSCSCLTVRNEERGENAGRPTHTTKMESIQVLEECQNPTAEEVLSWSQNFDKMMKAPAGRNLFREFLRTEYSEENLLFWLACEDLKKEQNKKVIEEKARMIYEDYISILSPKEVSLDSRVREVINRNLLDPNPHMYEDAQLQIYTLMHRDSFPRFLNSQIYKSFVESTAGSSSES

SEQ ID NO: 72323 - protein, 210 aa, Homo sapiens; identical to SEQ ID NO: 72322
  Payload ID: 14323
  Gene Symbol: RGS17
  Gene Name: regulator of G-protein signaling 17
  Uniprot ID: Q9UGC6
  ENSP ID: ENSP00000356194

SEQ ID NO: 72324 - protein, 235 aa, Homo sapiens
  Payload ID: 14324
  Gene Symbol: RGS18
  Gene Name: regulator of G-protein signaling 18
  Uniprot ID: Q9NS28
  ENSP ID: ENSP00000356430
METTLLFFSQINMCESKEKTFFKLIHGSGKEETSKEAKIRAKEKRNRLSLLVQKPEFHEDTRSSRSGHLAKETRVSPEEAVKWGESFDKLLSHRDGLEAFTRFLKTEFSEENIEFWIACEDFKKSKGPQQIHLKAKAIYEKFIQTDAPKEVNLDFHTKEVITNSITQPTLHSFDAAQSRVYQLMEQDSYTRFLKSDIYLDLMEGRPQRPTNLRRRSRSFTCNEFQDVQSDVAIWL

SEQ ID NO: 72325 - protein, 217 aa, Homo sapiens
  Payload ID: 14325
  Gene Symbol: RGS19
  Gene Name: regulator of G-protein signaling 19
  Uniprot ID: P49795
  ENSP ID: ENSP00000333194
MPTPHEAEKQITGPEEADRPPSMSSHDTASPAAPSRNPCCLCWCCCCSCSWNQERRRAWQASRESKLQPLPSCEVCATPSPEEVQSWAQSFDKLMHSPAGRSVFRAFLRTEYSEENMLFWLACEELKAEANQHVVDEKARLIYEDYVSILSPKEVSLDSRVREGINKKMQEPSAHTFDDAQLQIYTLMHRDSYPRFLSSPTYRALLLQGPSQSSSEA

SEQ ID NO: 72326 - protein, 217 aa, Homo sapiens; identical to SEQ ID NO: 72325
  Payload ID: 14325
  Gene Symbol: RGS19
  Gene Name: regulator of G-protein signaling 19
  Uniprot ID: P49795
  ENSP ID: ENSP00000378483

SEQ ID NO: 72327 - protein, 211 aa, Homo sapiens
  Payload ID: 14326
  Gene Symbol: RGS2
  Gene Name: regulator of G-protein signaling 2
  Uniprot ID: P41220
  ENSP ID: ENSP00000235382
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 72328 - protein, 241 aa, Homo sapiens
  Payload ID: 14327
  Gene Symbol: RGS20
  Gene Name: regulator of G-protein signaling 20
  Uniprot ID: O76081
  ENSP ID: ENSP00000276500
MRTADGGEPAGASSPAGRVDGGLQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 72329 - protein, 388 aa, Homo sapiens
  Payload ID: 14327
  Gene Symbol: RGS20
  Gene Name: regulator of G-protein signaling 20
  Uniprot ID: O76081
  ENSP ID: ENSP00000297313
MPQLSQDNQECLQKHFSRPSIWTQFLPLFRAQRYNTDIHQITENEGDLRAVPDIKSFPPAQLPDSPAAPKLFGLLSSPLSSLARFFSHLLRRPPPEAPRRRLDFSPLLPALPAARLSRGHEELPGRLSLLLGAALALPGRPSGGRPLRPPHPVAKPREEDATAGQSSPMPQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 72330 - protein, 273 aa, Homo sapiens
  Payload ID: 14327
  Gene Symbol: RGS20
  Gene Name: regulator of G-protein signaling 20
  Uniprot ID: O76081
  ENSP ID: ENSP00000344630
MPQLSQDNQECLQKHFSRPSIWTQFLPLFRAQRYNTDIHQITENEGDLRAVPDIKQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 72331 - protein, 58 aa, Homo sapiens
  Payload ID: 14327
  Gene Symbol: RGS20
  Gene Name: regulator of G-protein signaling 20
  ENSP ID: ENSP00000428795
MPQLSQDNQECLQKHFSRPSIWTQFLPLFRAQRYNTDIHQITENEGDLRAVPDIKSHC

SEQ ID NO: 72332 - protein, 70 aa, Homo sapiens
  Payload ID: 14327
  Gene Symbol: RGS20
  Gene Name: regulator of G-protein signaling 20
  ENSP ID: ENSP00000429897
MPQLSQDNQECLQKHFSRPSIWTQFLPLFRAQRYNTDIHQITENEGDLRAVPDIKPCSYSGRSQRLGSVI

SEQ ID NO: 72333 - protein, 122 aa, Homo sapiens
  Payload ID: 14327
  Gene Symbol: RGS20
  Gene Name: regulator of G-protein signaling 20
  ENSP ID: ENSP00000430627
MVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 72334 - protein, 152 aa, Homo sapiens
  Payload ID: 14328
  Gene Symbol: RGS21
  Gene Name: regulator of G-protein signaling 21
  Uniprot ID: Q2M5E4
  ENSP ID: ENSP00000428343
MPVKCCFYRSPTAETMTWSENMDTLLANQAGLDAFRIFLKSEFSEENVEFWLACEDFKKTKNADKIASKAKMIYSEFIEADAPKEINIDFGTRDLISKNIAEPTLKCFDEAQKLIYCLMAKDSFPRFLKSEIYKKLVNSQQVPNHKKWLPFL

SEQ ID NO: 72335 - protein, 1264 aa, Homo sapiens
  Payload ID: 14329
  Gene Symbol: RGS22
  Gene Name: regulator of G-protein signaling 22
  Uniprot ID: Q8NE09
  ENSP ID: ENSP00000354109
MPEKRLTAEPPTITEEEFEDSLATDDFLVDYFNEFLSLPTFSEAIRFNADYGVFEVANDAPQFLEKQLKKILQNQQPRNPIYDVVRKGKNEVKPVQMNAPDEDETINVNYNIMCLSREEGIKWIKKERLPAFLESDCYFEYRLAKLVSQVRWSKSGMNFTVGSNFSPWIVKKPPSLPPPATEEDNLVIMKKFYVSLGEASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLYWAPRFCVTHSASTKYASAELKFWHLRQAKPRKDIDPFPQMATLLPLRPKSCIPQIPEIQKEEFSLSQPPKSPNKSPEVKTATQKPWKRELLYPGSSKDDVIEKGSKYMSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 72336 - protein, 269 aa, Homo sapiens
  Payload ID: 14329
  Gene Symbol: RGS22
  Gene Name: regulator of G-protein signaling 22
  ENSP ID: ENSP00000427754
MDCGARGVEGAMETWQEDSLATDDFLVDYFNEFLSLPYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEI

SEQ ID NO: 72337 - protein, 504 aa, Homo sapiens
  Payload ID: 14329
  Gene Symbol: RGS22
  Gene Name: regulator of G-protein signaling 22
  Uniprot ID: Q8NE09
  ENSP ID: ENSP00000427798
MPEKRLTAEPPTITEEEFEDSLATDDFLVDYFNEFLSLPTFSEAIRFNADYGVFEVANDAPQFLEKQLKKILQNQQPRNPIYDVVRKGKNEVKPVQMNAPDEDETINVNYNIMCLSREEGIKWIKKERLPAFLESDCYFEYRLAKLVSQVRWSKSGMNFTVGSNFSPWIVKKPPSLPPPATEEDNLVIMKKFYVSLGEASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLY

SEQ ID NO: 72338 - protein, 82 aa, Homo sapiens
  Payload ID: 14329
  Gene Symbol: RGS22
  Gene Name: regulator of G-protein signaling 22
  ENSP ID: ENSP00000427930
MNAPDEDETINVNYNIMCLSREEGIKWIKKERLPAFLESDCYFEYRLAKLVSQVRWSKSGMNFTVGSNFSPWIVKKPPSLPP

SEQ ID NO: 72339 - protein, 1252 aa, Homo sapiens
  Payload ID: 14329
  Gene Symbol: RGS22
  Gene Name: regulator of G-protein signaling 22
  Uniprot ID: Q8NE09
  ENSP ID: ENSP00000428212
MPEKRLTAEPPTITEEEFEDSLATDDFLVDYFNEFLSLPTFSEAIRFNADYGVFEVANDAPQFLEKQLKKILQNQQPRNPIYDVVRKGKNEVKPVQMNAPDEDETINVNYNIMCLSREEGIKWIKKERLPAFLESDCYFEYRLAKLVSQVRWSKSGMNFTVGSNFSPWIVKKPPSLPPPATEEDNLASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLYWAPRFCVTHSASTKYASAELKFWHLRQAKPRKDIDPFPQMATLLPLRPKSCIPQIPEIQKEEFSLSQPPKSPNKSPEVKTATQKPWKRELLYPGSSKDDVIEKGSKYMSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 72340 - protein, 136 aa, Homo sapiens
  Payload ID: 14329
  Gene Symbol: RGS22
  Gene Name: regulator of G-protein signaling 22
  ENSP ID: ENSP00000429198
MILRPPQPCGTEDSLATDDFLVDYFNEFLSLPCLSREEGIKWIKKERLPAFLESDCYFEYRLAKLVSQVRWSKSGMNFTVGSNFSPWIVKKPPSLPPPATEEDNLVIMKKFYVSLGEASYTQTKDWFALAKQSQQT

SEQ ID NO: 72341 - protein, 1083 aa, Homo sapiens
  Payload ID: 14329
  Gene Symbol: RGS22
  Gene Name: regulator of G-protein signaling 22
  ENSP ID: ENSP00000429382
MNAPDEDETINVNYNIMASYTQTKDWFALAKQSQQTVSTFSLPCCVPYNKLKSPAISSVSENFIFDDGVHPRTKKDPSKTNKLISEFEEEEGEEEEVSVSLQDTPSQALLRVYLEKKQDVDESLTMHFSTCEEFLSSYIYFILRGAIQQIVGKPVGETPDYINFNNITKVSFDDCFESIHGKNFLSELVQTTKERSEEIEQTSLSSKNESAGPESRADWCISHRTYDIGNRKEFERFKKFIKGTLGERYWWLWMDIERLKVLKDPGRHQRHLEKMKKCYLVSNGDYYLSAEILSKFKLLDGSQWNEEHLRNIQSEVLKPLLLYWAPRFCVTHSASTKYASAELKFWHLRQAKPRKDIDPFPQMATLLPLRPKSCIPQIPEIQKEEFSLSQPPKSPNKSPEVKTATQKPWKRELLYPGSSKDDVIEKGSKYMSESSKVIHLTSFTDISECLKPQLDRRYAYTEEPRVKTVSDVGALGGSDMENLLQSLYVENRAGFFFTKFCEHSGNKLWKNSVYFWFDLQAYHQLFYQETLQPFKVCKQAQYLFATYVAPSATLDIGLQQEKKKEIYMKIQPPFEDLFDTAEEYILLLLLEPWTKMVKSDQIAYKKVELVEETRQLDSTYFRKLQALHKETFSKKAEDTTCEIGTGILSLSNVSKRTEYWDNVPAEYKHFKFSDLLNNKLEFEHFRQFLETHSSSMDLMCWTDIEQFRRITYRDRNQRKAKSIYIKNKYLNKKYFFGPNSPASLYQQNQVMHLSGGWGKILHEQLDAPVLVEIQKHVQNRLENVWLPLFLASEQFAARQKIKVQMKDIAEELLLQKAEKKIGVWKPVESKWISSSCKIIAFRKALLNPVTSRQFQRFVALKGDLLENGLLFWQEVQKYKDLCHSHCDESVIQKKITTIINCFINSSIPPALQIDIPVEQAQKIIEHRKELGPYVFREAQMTIFGVLFKFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGLQPLTNFKASSSTMSLKKNMSAHSSQK

SEQ ID NO: 72342 - protein, 111 aa, Homo sapiens
  Payload ID: 14329
  Gene Symbol: RGS22
  Gene Name: regulator of G-protein signaling 22
  ENSP ID: ENSP00000430378
KFWPQFCEFRKNLTDENIMSVLERRQEYNKQKKKLAVLEDEKSGKDGIKQYANTSVPAIKTALLSDSFLGLQPYGRQPTWCYSKYIEALEQERILLKIQEELEKKLFAGIL

SEQ ID NO: 72343 - protein, 88 aa, Homo sapiens
  Payload ID: 14329
  Gene Symbol: RGS22
  Gene Name: regulator of G-protein signaling 22
  ENSP ID: ENSP00000430903
MNAPDEDETINVNYNIMCLSREEGIKWIKKERLPAFLESDCYFEYRLAKLVSQVRWSKSGMNFTVGSNFSPWIVKKPPSLPPPATEED

SEQ ID NO: 72344 - protein, 1251 aa, Homo sapiens [sequence omitted]

SEQ ID NO: 72345 - protein, 1198 aa, Homo sapiens
  Payload ID: 14330
  Gene Symbol: RGS3
  Gene Name: regulator of G-protein signaling 3
  Uniprot ID: P49796
  ENSP ID: ENSP00000259406
MPVIPALWEVEMGRSQGQEIETILANRSHSDSTPLPNFLSGSHRPECCTCRLLTASGAQDSLPFGRRLYSGPWRSCEEVCHVSVLSVLSTSCGLSLSLPIFPGWMEWLSPDIALPRRDEWTQTSPARKRITHAKVQGAGQLRLSIDAQDRVLLLHIIEGKGLISKQPGTCDPYVKISLIPEDSRLRHQKTQTVPDCRDPAFHEHFFFPVQEEDDQKRLLVTVWNRASQSRQSGLIGCMSFGVKSLLTPDKEISGWYYLLGEHLGRTKHLKVARRRLRPLRDPLLRMPGGGDTENGKKLKITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 72346 - protein, 602 aa, Homo sapiens
  Payload ID: 14330
  Gene Symbol: RGS3
  Gene Name: regulator of G-protein signaling 3
  Uniprot ID: P49796
  ENSP ID: ENSP00000312844
MERSLHRVSLGSRRAHPDLSFYLTTFGQLRLSIDAQDRVLLLHIIEGKGLISKQPGTCDPYVKISLIPEDSRLRHQKTQTVPDCRDPAFHEHFFFPVQEEDDQKRLLVTVWNRASQSRQSGLIGCMSFGVKSLLTPDKEISGWYYLLGEHLGRTKHLKVARRRLRPLRDPLLRMPGGGDTENGKKLKITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKKLHPFGSLQQEMGPVNSTNATQDRSFTSPGQTLIG

SEQ ID NO: 72347 - protein, 917 aa, Homo sapiens
  Payload ID: 14330
  Gene Symbol: RGS3
  Gene Name: regulator of G-protein signaling 3
  Uniprot ID: P49796
  ENSP ID: ENSP00000340284
MNRFNGLCKVCSERRYRQITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 72348 - protein, 168 aa, Homo sapiens
  Payload ID: 14330
  Gene Symbol: RGS3
  Gene Name: regulator of G-protein signaling 3
  ENSP ID: ENSP00000343359
MKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 72349 - protein, 519 aa, Homo sapiens
  Payload ID: 14330
  Gene Symbol: RGS3
  Gene Name: regulator of G-protein signaling 3
  Uniprot ID: P49796
  ENSP ID: ENSP00000363249
MFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 72350 - protein, 340 aa, Homo sapiens
  Payload ID: 14330
  Gene Symbol: RGS3
  Gene Name: regulator of G-protein signaling 3
  ENSP ID: ENSP00000363251
MVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKKLHPFGSLQQEMGPVNSTNATQDRSFTSPGQTLIG

SEQ ID NO: 72351 - protein, 1198 aa, Homo sapiens; identical to SEQ ID NO: 72345
  Payload ID: 14330
  Gene Symbol: RGS3
  Gene Name: regulator of G-protein signaling 3
  Uniprot ID: P49796
  ENSP ID: ENSP00000363255

SEQ ID NO: 72352 - protein, 591 aa, Homo sapiens
  Payload ID: 14330
  Gene Symbol: RGS3
  Gene Name: regulator of G-protein signaling 3
  Uniprot ID: P49796
  ENSP ID: ENSP00000378141
MNRFNGLCKVCSERRYRQITIPRGKDGFGFTICCDSPVRVQAVDSGGPAERAGLQQLDTVLQLNERPVEHWKCVELAHEIRSCPSEIILLVWRMVPQVKPGPDGGVLRRASCKSTHDLQSPPNKREKNCTHGVQARPEQRHSCHLVCDSSDGLLLGGWERYTEVAKRGGQHTLPALSRATAPTDPNYIILAPLNPGSQLLRPVYQEDTIPEESGSPSKGKSYTGLGKKSRLMKTVQTMKGHGNYQNCPVVRPHATHSSYGTYVTLAPKVLVFPVFVQPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 72353 - protein, 74 aa, Homo sapiens
  Payload ID: 14330
  Gene Symbol: RGS3
  Gene Name: regulator of G-protein signaling 3
  ENSP ID: ENSP00000417866
MFETEADEKREMALEEGKGPGAEDSPPSKEPSPGQELPPGQDLPPNKDSPSGQEPAPSQEPLSSKDSATSEGSP

SEQ ID NO: 72354 - protein, 247 aa, Homo sapiens
  Payload ID: 14330
  Gene Symbol: RGS3
  Gene Name: regulator of G-protein signaling 3
  ENSP ID: ENSP00000417994
MFETEADEKREMALEEGKGPGAEDSPPSKEPSPGQELPPGQDLPPNKDSPSGQEPAPSQEPLSSKDSATSEGSPPGPDAPPSKDVPPCQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHK

SEQ ID NO: 72355 - protein, 214 aa, Homo sapiens
  Payload ID: 14330
  Gene Symbol: RGS3
  Gene Name: regulator of G-protein signaling 3
  ENSP ID: ENSP00000418898
  MOD_RES (1)..(1): Any amino acid
XWLDFLSMSVALTPLDLCNPARTLLLSEELLLYEGRNKAAEVTLFAYSDLLLFTKEDEPGRCDVLRNPLYLQSVKLQEGSSEDLKFCVLYLAEKAECLFTLEAHSQEQKKRVCWCLSENIAKQQQLAASPPDSKMFETEADEKREMALEEGKGPGAEDSPPSKEPSPGQELPPGQDLPPNKDSPSGQEPAPSQEPLSSKDSATSEGSPPGPDAP

SEQ ID NO: 72356 - protein, 519 aa, Homo sapiens; identical to SEQ ID NO: 72349
  Payload ID: 14330
  Gene Symbol: RGS3
  Gene Name: regulator of G-protein signaling 3
  Uniprot ID: P49796
  ENSP ID: ENSP00000420356

SEQ ID NO: 72357 - protein, 311 aa, Homo sapiens
  Payload ID: 14330
  Gene Symbol: RGS3
  Gene Name: regulator of G-protein signaling 3
  Uniprot ID: P49796
  ENSP ID: ENSP00000436168
MVTRRPVTNSWDWLPAGAAPEAVPCRHMPLSRLPLRVGQKEFFFPLPLLVPPISWLLLSESQPRLVPGSPVIRPGFQRACVAAACTVAARCPGRGVGDRSQSGASYRPICGPKVGGPTEMLRGMYLTRNGNLQRRHTMKEAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 72358 - protein, 192 aa, Homo sapiens
  Payload ID: 14330
  Gene Symbol: RGS3
  Gene Name: regulator of G-protein signaling 3
  ENSP ID: ENSP00000479017
MLRGMYLTRNGNLQRRHTMKEAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 72359 - protein, 311 aa, Homo sapiens; identical to SEQ ID NO: 72357
  Payload ID: 14330
  Gene Symbol: RGS3
  Gene Name: regulator of G-protein signaling 3
  Uniprot ID: P49796
  ENSP ID: ENSP00000482612

SEQ ID NO: 72360 - protein, 187 aa, Homo sapiens
  Payload ID: 14331
  Gene Symbol: RGS4
  Gene Name: regulator of G-protein signaling 4
  Uniprot ID: P49798
  ENSP ID: ENSP00000356882
MKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 72361 - protein, 93 aa, Homo sapiens
  Payload ID: 14331
  Gene Symbol: RGS4
  Gene Name: regulator of G-protein signaling 4
  Uniprot ID: P49798
  ENSP ID: ENSP00000356884
MCKGLAGLPASCLRSAKDMKHRLGFLLQKSDSCEHNSSHNKKDKVVICQRVSQEEVKKWAESLENLISHECEPGFLHQGRDKPEHARAYNNLL

SEQ ID NO: 72362 - protein, 205 aa, Homo sapiens
  Payload ID: 14331
  Gene Symbol: RGS4
  Gene Name: regulator of G-protein signaling 4
  Uniprot ID: P49798
  ENSP ID: ENSP00000356885
MCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 72363 - protein, 302 aa, Homo sapiens
  Payload ID: 14331
  Gene Symbol: RGS4
  Gene Name: regulator of G-protein signaling 4
  Uniprot ID: P49798
  ENSP ID: ENSP00000397181
MYNMMLLIQKRKGIGSQLLRAGEAEGDRGAGTAERSSDWLDGRSWAIKETPTGLAGRRSEDSDNIFTGEEAKYAQSRSHSSSCRISFLLANSKLLNKMCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 72364 - protein, 143 aa, Homo sapiens
  Payload ID: 14331
  Gene Symbol: RGS4
  Gene Name: regulator of G-protein signaling 4
  ENSP ID: ENSP00000432194
MKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLME

SEQ ID NO: 72365 - protein, 187 aa, Homo sapiens; identical to SEQ ID NO: 72360
  Payload ID: 14331
  Gene Symbol: RGS4
  Gene Name: regulator of G-protein signaling 4
  Uniprot ID: P49798
  ENSP ID: ENSP00000433261

SEQ ID NO: 72366 - protein, 113 aa, Homo sapiens
  Payload ID: 14331
  Gene Symbol: RGS4
  Gene Name: regulator of G-protein signaling 4
  ENSP ID: ENSP00000436106
MCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKY

SEQ ID NO: 72367 - protein, 181 aa, Homo sapiens
  Payload ID: 14332
  Gene Symbol: RGS5
  Gene Name: regulator of G-protein signaling 5
  Uniprot ID: O15539
  ENSP ID: ENSP00000319308
MCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 72368 - protein, 201 aa, Homo sapiens
  Payload ID: 14332
  Gene Symbol: RGS5
  Gene Name: regulator of G-protein signaling 5
  ENSP ID: ENSP00000356879
MCARNISQDILILQMHSAHWHINGKYEEKSNLMFWAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 72369 - protein, 73 aa, Homo sapiens
  Payload ID: 14332
  Gene Symbol: RGS5
  Gene Name: regulator of G-protein signaling 5
  Uniprot ID: O15539
  ENSP ID: ENSP00000432313
MAEKAKQIYEEFIQTEAPKEVNIDHFTKDITMKNLVEPSLSSFDMAQKRIHALMEKDSLPRFVRSEFYQELIK

SEQ ID NO: 72370 - protein, 185 aa, Homo sapiens
  Payload ID: 14332
  Gene Symbol: RGS5
  Gene Name: regulator of G-protein signaling 5
  Uniprot ID: O15539
  ENSP ID: ENSP00000433001
MCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVGLWVNIDHFTKDITMKNLVEPSLSSFDMAQKRIHALMEKDSLPRFVRSEFYQELIK

SEQ ID NO: 72371 - protein, 71 aa, Homo sapiens
  Payload ID: 14332
  Gene Symbol: RGS5
  Gene Name: regulator of G-protein signaling 5
  ENSP ID: ENSP00000435861
MCKGLAALPHSCLERTSLDEALQWRDSLDKLLQNNYGLASFKSFLKSEFSEENLEFWIACEDYKKIKSPAK

SEQ ID NO: 72372 - protein, 73 aa, Homo sapiens; identical to SEQ ID NO: 72369
  Payload ID: 14332
  Gene Symbol: RGS5
  Gene Name: regulator of G-protein signaling 5
  Uniprot ID: O15539
  ENSP ID: ENSP00000480891

SEQ ID NO: 72373 - protein, 418 aa, Homo sapiens
  Payload ID: 14333
  Gene Symbol: RGS6
  Gene Name: regulator of G-protein signaling 6
  ENSP ID: ENSP00000341199
MQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 72374 - protein, 460 aa, Homo sapiens
  Payload ID: 14333
  Gene Symbol: RGS6
  Gene Name: regulator of G-protein signaling 6
  Uniprot ID: P49758
  ENSP ID: ENSP00000347699
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKVWLL

SEQ ID NO: 72375 - protein, 437 aa, Homo sapiens
  Payload ID: 14333
  Gene Symbol: RGS6
  Gene Name: regulator of G-protein signaling 6
  ENSP ID: ENSP00000383953
MQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKGKSLAGKRLTGLMQSS

SEQ ID NO: 72376 - protein, 475 aa, Homo sapiens
  Payload ID: 14333
  Gene Symbol: RGS6
  Gene Name: regulator of G-protein signaling 6
  Uniprot ID: P49758
  ENSP ID: ENSP00000384218
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVG

SEQ ID NO: 72377 - protein, 477 aa, Homo sapiens
  Payload ID: 14333
  Gene Symbol: RGS6
  Gene Name: regulator of G-protein signaling 6
  Uniprot ID: P49758
  ENSP ID: ENSP00000384612
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVLLF

SEQ ID NO: 72378 - protein, 480 aa, Homo sapiens
  Payload ID: 14333
  Gene Symbol: RGS6
  Gene Name: regulator of G-protein signaling 6
  Uniprot ID: P49758
  ENSP ID: ENSP00000385243
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVCLQLLF

SEQ ID NO: 72379 - protein, 539 aa, Homo sapiens
  Payload ID: 14333
  Gene Symbol: RGS6
  Gene Name: regulator of G-protein signaling 6
  ENSP ID: ENSP00000412144
MKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVNVQNTRPAGAWSIFMAALPMAVWLRTPRSCHGLSESRLLGLPSLHDGLREGQSLPQSCPGSSSTAAEGARERASNGRSLARRQHCQCHGQGEETQLCLWSRLESSKRSQRASSLRTSKAKKKRQTVKQGPKAWP

SEQ ID NO: 72380 - protein, 465 aa, Homo sapiens
  Payload ID: 14333
  Gene Symbol: RGS6
  Gene Name: regulator of G-protein signaling 6
  Uniprot ID: P49758
  ENSP ID: ENSP00000450858
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKKVSKVVELP

SEQ ID NO: 72381 - protein, 472 aa, Homo sapiens
  Payload ID: 14333
  Gene Symbol: RGS6
  Gene Name: regulator of G-protein signaling 6
  Uniprot ID: P49758
  ENSP ID: ENSP00000450936
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKGKSLAGKRLTGLMQSS

SEQ ID NO: 72382 - protein, 490 aa, Homo sapiens
  Payload ID: 14333
  Gene Symbol: RGS6
  Gene Name: regulator of G-protein signaling 6
  Uniprot ID: P49758
  ENSP ID: ENSP00000451030
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 72383 - protein, 490 aa, Homo sapiens; identical to SEQ ID NO: 72382
  Payload ID: 14333
  Gene Symbol: RGS6
  Gene Name: regulator of G-protein signaling 6
  Uniprot ID: P49758
  ENSP ID: ENSP00000451855

SEQ ID NO: 72384 - protein, 346 aa, Homo sapiens
  Payload ID: 14333
  Gene Symbol: RGS6
  Gene Name: regulator of G-protein signaling 6
  Uniprot ID: P49758
  ENSP ID: ENSP00000451912
MQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVLYSNTPLAKRP

SEQ ID NO: 72385 - protein, 472 aa, Homo sapiens; identical to SEQ ID NO: 72381
  Payload ID: 14333
  Gene Symbol: RGS6
  Gene Name: regulator of G-protein signaling 6
  Uniprot ID: P49758
  ENSP ID: ENSP00000452331

SEQ ID NO: 72386 - protein, 455 aa, Homo sapiens
  Payload ID: 14333
  Gene Symbol: RGS6
  Gene Name: regulator of G-protein signaling 6
  ENSP ID: ENSP00000478186
MQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 72387 - protein, 424 aa, Homo sapiens
  Payload ID: 14334
  Gene Symbol: RGS7
  Gene Name: regulator of G-protein signaling 7
  Uniprot ID: P49802
  ENSP ID: ENSP00000341242
MAQGNNYGQTSNGVADESPNMLVYRKMEDVIARMQDEKNGIPIRTVKSFLSKIPSVFSGSDIVQWLIKNLTIEDPAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGRNIPIFPCHKNCTPTLRASTNLL

SEQ ID NO: 72388 - protein, 411 aa, Homo sapiens
  Payload ID: 14334
  Gene Symbol: RGS7
  Gene Name: regulator of G-protein signaling 7
  ENSP ID: ENSP00000355520
MAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKSGNSMDRRTSFEKFAQNVGRNIPIFPCHKNCTPTLRASTNLL

SEQ ID NO: 72389 - protein, 477 aa, Homo sapiens
  Payload ID: 14334
  Gene Symbol: RGS7
  Gene Name: regulator of G-protein signaling 7
  Uniprot ID: P49802
  ENSP ID: ENSP00000355521
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGRNIPIFPCHKNCTPTLRASTNLL

SEQ ID NO: 72390 - protein, 469 aa, Homo sapiens
  Payload ID: 14334
  Gene Symbol: RGS7
  Gene Name: regulator of G-protein signaling 7
  Uniprot ID: P49802
  ENSP ID: ENSP00000355522
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGKSLTSKRLTSLAQSY

SEQ ID NO: 72391 - protein, 487 aa, Homo sapiens
  Payload ID: 14334
  Gene Symbol: RGS7
  Gene Name: regulator of G-protein signaling 7
  Uniprot ID: P49802
  ENSP ID: ENSP00000355523
MAQGNNYGQTSNGVADESPNMLVYRKMEDVIARMQDEKNGIPIRTVKSFLSKIPSVFSGSDIVQWLIKNLTIEDPVEALHLGTLMAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKSGNSMDRRTSFEKFAQNVGKSLTSKRLTSLAQSY

SEQ ID NO: 72392 - protein, 398 aa, Homo sapiens
  Payload ID: 14334
  Gene Symbol: RGS7
  Gene Name: regulator of G-protein signaling 7
  ENSP ID: ENSP00000385508
MEDVIARMQDEKNGIPIRTVKSFLSKIPSVFSGSDIVQWLIKNLTIEDPAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGRNIPIFPCHKNCTPTLRASTNLL

SEQ ID NO: 72393 - protein, 393 aa, Homo sapiens
  Payload ID: 14334
  Gene Symbol: RGS7
  Gene Name: regulator of G-protein signaling 7
  ENSP ID: ENSP00000390138
MAAHGYFFPISDHVLTLKDDGTFYRFQTPYFWPSNCWEPENTDYAVYLCKRTMQNKARLELADYEAESLARLQRAFARKWEFIFMQAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKGRNIPIFPCHKNCTPTLRASTNLL

SEQ ID NO: 72394 - protein, 326 aa, Homo sapiens
  Payload ID: 14334
  Gene Symbol: RGS7
  Gene Name: regulator of G-protein signaling 7
  ENSP ID: ENSP00000404399
QAEAQAKVDKKRDKIERKILDSQERAFWDVHRPVPGCVNTTEVDIKKSSRMRNPHKTRKSVYGLQNDIRSHSPTHTPTPETKPPTEDELQQQIKYWQIQLDRHRLKMSKVADSLLSYTEQYLEYDPFLLPPDPSNPWLSDDTTFWELEASKEPSQQRVKRWGFGMDEALKDPVGREQFLKFLESEFSSENLRFWLAVEDLKKRPIKEVPSRVQEIWQEFLAPGAPSAINLDSKSYDKTTQNVKEPGRYTFEDAQEHIYKLMKSDSYPRFIRSSAYQELLQAKKKSGNSMDRRTSFEKFAQNVGRNIPIFPCHKNCTPTLRASTNLL

SEQ ID NO: 72395 - protein, 257 aa, Homo sapiens
  Payload ID: 14335
  Gene Symbol: RGS7BP
  Gene Name: regulator of G-protein signaling 7 binding protein
  Uniprot ID: Q6MZT1
  ENSP ID: ENSP00000334851
MSSAPNGRKKRPSRSTRSSIFQISKPPLQSGDWERRGSGSESAHKTQRALDDCKMLVQEFNTQVALYRELVISIGDVSVSCPSLRAEMHKTRTKGCEMARQAHQKLAAISGPEDGEIHPEICRLYIQLQCCLEMYTTEMLKSICLLGSLQFHRKGKEPGGGTKSLDCKIEESAETPALEDSSSSPVDSQQHSWQVSTDIENTERDMREMKNLLSKLRETMPLPLKNQDDSSLLNLTPYPLVRRRKRRFFGLCCLISS

SEQ ID NO: 72396 - protein, 198 aa, Homo sapiens
  Payload ID: 14336
  Gene Symbol: RGS8
  Gene Name: regulator of G-protein signaling 8
  Uniprot ID: P57771
  ENSP ID: ENSP00000258302
MWNTLTRSLSDHPVGKDPQAMRTGQRQNKGMRTRLGCLSHKSDSCSDFTAILPDKPNRALKRLSTEEATRWADSFDVLLSHKYGVAAFRAFLKTEFSEENLEFWLACEEFKKTRSTAKLVSKAHRIFEEFVDVQAPREVNIDFQTREATRKNLQEPSLTCFDQAQGKVHSLMEKDSYPRFLRSKMYLDLLSQSQRRLS

SEQ ID NO: 72397 - protein, 180 aa, Homo sapiens
  Payload ID: 14336
  Gene Symbol: RGS8
  Gene Name: regulator of G-protein signaling 8
  Uniprot ID: P57771
  ENSP ID: ENSP00000356527
MAALLMPRRNKGMRTRLGCLSHKSDSCSDFTAILPDKPNRALKRLSTEEATRWADSFDVLLSHKYGVAAFRAFLKTEFSEENLEFWLACEEFKKTRSTAKLVSKAHRIFEEFVDVQAPREVNIDFQTREATRKNLQEPSLTCFDQAQGKVHSLMEKDSYPRFLRSKMYLDLLSQSQRRLS

SEQ ID NO: 72398 - protein, 180 aa, Homo sapiens; identical to SEQ ID NO: 72397
  Payload ID: 14336
  Gene Symbol: RGS8
  Gene Name: regulator of G-protein signaling 8
  Uniprot ID: P57771
  ENSP ID: ENSP00000356528

SEQ ID NO: 72399 - protein, 180 aa, Homo sapiens; identical to SEQ ID NO: 72397
  Payload ID: 14336
  Gene Symbol: RGS8
  Gene Name: regulator of G-protein signaling 8
  Uniprot ID: P57771
  ENSP ID: ENSP00000426289

SEQ ID NO: 72400 - protein, 57 aa, Homo sapiens
  Payload ID: 14336
  Gene Symbol: RGS8
  Gene Name: regulator of G-protein signaling 8
  ENSP ID: ENSP00000427076
MAALLMPRRNKGMRTRLGCLSHKSDSCSDFTAILPDKPNRALKRLSTEEATRWADSF

SEQ ID NO: 72401 - protein, 674 aa, Homo sapiens
  Payload ID: 14337
  Gene Symbol: RGS9
  Gene Name: regulator of G-protein signaling 9
  Uniprot ID: O75916
  ENSP ID: ENSP00000262406
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 72402 - protein, 671 aa, Homo sapiens
  Payload ID: 14337
  Gene Symbol: RGS9
  Gene Name: regulator of G-protein signaling 9
  Uniprot ID: O75916
  ENSP ID: ENSP00000396329
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 72403 - protein, 628 aa, Homo sapiens
  Payload ID: 14337
  Gene Symbol: RGS9
  Gene Name: regulator of G-protein signaling 9
  ENSP ID: ENSP00000405814
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVAK

SEQ ID NO: 72404 - protein, 494 aa, Homo sapiens
  Payload ID: 14337
  Gene Symbol: RGS9
  Gene Name: regulator of G-protein signaling 9
  ENSP ID: ENSP00000463410
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKRQLHPPFYAASPALQPKPCHPETAGRGSQGPRSSQHCGHHPAGPAHGSQPPSDRVHRDLHAPVSF

SEQ ID NO: 72405 - protein, 29 aa, Homo sapiens
  Payload ID: 14338
  Gene Symbol: RGSL1
  Gene Name: regulator of G-protein signaling like 1
  ENSP ID: ENSP00000454954
AQKEICKMLSPWYDEFLDEEDYWFLLFTT

SEQ ID NO: 72406 - protein, 64 aa, Homo sapiens
  Payload ID: 14338
  Gene Symbol: RGSL1
  Gene Name: regulator of G-protein signaling like 1
  ENSP ID: ENSP00000454969
MMRWKKADQWLLQKCIGGVRGMWRFYSYLTGSAGEELVDFWILAENILSIDEMDLEVRDYYLSL

SEQ ID NO: 72407 - protein, 29 aa, Homo sapiens
  Payload ID: 14338
  Gene Symbol: RGSL1
  Gene Name: regulator of G-protein signaling like 1
  ENSP ID: ENSP00000454981
MMRWKKADQWLLQKCIGGVRGMWRFYSYL

SEQ ID NO: 72408 - protein, 154 aa, Homo sapiens
  Payload ID: 14338
  Gene Symbol: RGSL1
  Gene Name: regulator of G-protein signaling like 1
  ENSP ID: ENSP00000456332
MSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGEARVSLLKSNWWWCWRDSQEDDEIGSTRNLFPHLDNNCTGRICMICSVPGMMSF

SEQ ID NO: 72409 - protein, 984 aa, Homo sapiens
  Payload ID: 14338
  Gene Symbol: RGSL1
  Gene Name: regulator of G-protein signaling like 1
  ENSP ID: ENSP00000457491
MSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGAKMMRWKKADQWLLQKCIGGVRGMWRFYSYLTGSAGEELVDFWILAENILSIDEMDLEVRDYYLSLLLMLRATHLQEGSRVVTLCNMNIKSLLNLSIWHPNQSTTRREILSHMQKVALFKLQSYWLPNFYTHTKMTMAKEEACHGLMQEYETRLYSVCYTHIGGLPLNMSIKKCHHFQKRYSSRKAKRKMWQLVDPDSWSLEMDLKPDAIGMPLQETCPQEKVVIQMPSLKMASSKETRISSLEKDMHYAKISSMENKAKSHLHMEAPFETKVSTHLRTVIPIVNHSSKMTIQKAIKQSFSLGYIHLALCADACAGNPFRDHLKKLNLKVEIQLLDLWQDLQHFLSVLLNNKKNGNAIFRHLLGDRICELYLNEQIGPCLPLKSQTIQGLKELLPSGDVIPWIPKAQKEICKMLSPWYDEFLDEEDYWFLLFTTQNRFISSRQHKREFIGKEENILLYKRIQQSLELSQALADMKEMDYRQWRKIATEDLKQGGSLQVELTSPVFLTDITKMSFEELCYKNPKMAIQKISDDYKIYCEKAPKIDFKMEIIKETKTVSRSNRKMSLLKRTLVRKPSMRPRNLTEVLLNTQHLEFFREFLKERKAKIPLQFLTAVQKISIETNEKICKSLIENVIKTFFQGQLSPEEMLQCDAPIIKEIASMRHVTTSTLLTLQGHVMKSIEEKWFKDYQDLFPPHHQEVEVQSEVQISSRKPSKIVSTYLQESQKKGWMRMISFIRSFCKYRRFMLNPSKRQEFEDYLHQEMQNSKENFTTAHNTSGRSAPPSTNVRSADQENGEITLVKRRIFGHRIITVNFAINDLYFFSEMEKFNDLVSSAHMLQVNRAYNENDVILMRSKMNIIQKLFLNSDIPPKLRVLFLEGNPLLLTV

SEQ ID NO: 72410 - protein, 1076 aa, Homo sapiens
  Payload ID: 14338
  Gene Symbol: RGSL1
  Gene Name: regulator of G-protein signaling like 1
  Uniprot ID: A5PLK6
  ENSP ID: ENSP00000457748
MSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGGEELVDFWILAENILSIDEMDLEVRDYYLSLLLMLRATHLQEGSRVVTLCNMNIKSLLNLSIWHPNQSTTRREILSHMQKVALFKLQSYWLPNFYTHTKMTMAKEEACHGLMQEYETRLYSVCYTHIGGLPLNMSIKKCHHFQKRYSSRKAKRKMWQLVDPDSWSLEMDLKPDAIGMPLQETCPQEKVVIQMPSLKMASSKETRISSLEKDMHYAKISSMENKAKSHLHMEAPFETKVSTHLRTVIPIVNHSSKMTIQKAIKQSFSLGYIHLALCADACAGNPFRDHLKKLNLKVEIQLLDLWQDLQHFLSVLLNNKKNGNAIFRHLLGDRICELYLNEQIGPCLPLKSQTIQGLKELLPSGDVIPWIPKAQKEICKMLSPWYDEFLDEEDYWFLLFTTQNRFISSRQHKREFIGKEENILLYKRIQQSLELSQALADMKEMDYRQWRKIATEDLKQGGSLQVELTSPVFLTDITKMSFEELCYKNPKMAIQKISDDYKIYCEKAPKIDFKMEIIKETKTVSRSNRKMSLLKRTLVRKPSMRPRNLTEVLLNTQHLEFFREFLKERKAKIPLQFLTAVQKISIETNEKICKSLIENVIKTFFQGQLSPEEMLQCDAPIIKEIASMRHVTTSTLLTLQGHVMKSIEEKWFKDYQDLFPPHHQEVEVQSEVQISSRKPSKIVSTYLQESQKKGWMRMISFIRSFCKYRRFMLNPSKRQEFEDYLHQEMQNSKENFTTAHNTSGRSAPPSTNVRSADQENGEITLVKRRIFGHRIITVNFAINDLYFFSEMEKFNDLVSSAHMLQVNRAYNENDVILMRSKMNIIQKLFLNSDIPPKLRVNVPEFQKDAILAAITEGYLDRSVFHGAIMSVFPVVMYFWKRFCFWKATRSYLQYRGKKFKDRKSPPKSTDKYPFSSGGDNAILRFTLLRGIEWLQPQREAISSVQNSSSSKLTQPRLVVSAMQLHPVQGQKLSYIKKEK

SEQ ID NO: 72411 - protein, 160 aa, Homo sapiens
  Payload ID: 14338
  Gene Symbol: RGSL1
  Gene Name: regulator of G-protein signaling like 1
  ENSP ID: ENSP00000458086
MSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGGEELVDFWILAENILSIDEMDLEVRDYYLSLLLMLRATHLQEGSRVVTLCNMNINAQSLV

SEQ ID NO: 72412 - protein, 81 aa, Homo sapiens
  Payload ID: 14338
  Gene Symbol: RGSL1
  Gene Name: regulator of G-protein signaling like 1
  ENSP ID: ENSP00000488942
MQKVALFKLQSYWLPNFYTHTKMTMAKEEACHGLMQEYETRLYSVCYTHIGGLPLNMSIKKCHHFQKRYSSRKAKRKMWQL

SEQ ID NO: 72413 - protein, 46 aa, Homo sapiens
  Payload ID: 14338
  Gene Symbol: RGSL1
  Gene Name: regulator of G-protein signaling like 1
  ENSP ID: ENSP00000489421
MSSAEIIGSTNLIILLEDEVFADFFNTFLSLPLCFAGFWSDTILYC

SEQ ID NO: 72414 - protein, 31 aa, Homo sapiens
  Payload ID: 14338
  Gene Symbol: RGSL1
  Gene Name: regulator of G-protein signaling like 1
  ENSP ID: ENSP00000489498
MMRWKKADQWLLQKCIGGVRGMWRFYSYLTG

SEQ ID NO: 72415 - protein, 166 aa, Homo sapiens
  Payload ID: 14338
  Gene Symbol: RGSL1
  Gene Name: regulator of G-protein signaling like 1
  ENSP ID: ENSP00000489502
MDLEVRDYYLSLLLMLRATHLQEGSRVVTLCNMNIKSLLNLSIWHPNQSTTRREILSHMQKVALFKLQSYWLPNFYTHTKMTMAKEEACHGLMQEYETRLYSVCYTHIGGLPLNMSIKKCHHFQKRYSSRKAKRKMWQLVDPDSWSLEMDLKPDAIGMPLQETCPQ

SEQ ID NO: 72416 - protein, 57 aa, Homo sapiens
  Payload ID: 14338
  Gene Symbol: RGSL1
  Gene Name: regulator of G-protein signaling like 1
  ENSP ID: ENSP00000489508
  MOD_RES (1)..(1): Any amino acid
XRFTLLRGIEWLQPQREAISSVQNSSSSKLTQPRLVVSAMQLHPVQGNLIQPIQTKG

SEQ ID NO: 72417 - protein, 37 aa, Homo sapiens
  Payload ID: 14338
  Gene Symbol: RGSL1
  Gene Name: regulator of G-protein signaling like 1
  ENSP ID: ENSP00000489611
MMRWKKADQWLLQKCIGGVRGMWRFYSYLTGSAGEEL

SEQ ID NO: 72418 - protein, 314 aa, Homo sapiens
  Payload ID: 14339
  Gene Symbol: RMDN1
  Gene Name: regulator of microtubule dynamics 1
  Uniprot ID: Q96DB5
  ENSP ID: ENSP00000385927
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 72419 - protein, 284 aa, Homo sapiens
  Payload ID: 14339
  Gene Symbol: RMDN1
  Gene Name: regulator of microtubule dynamics 1
  Uniprot ID: Q96DB5
  ENSP ID: ENSP00000409661
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQIQTEAAQLLTSFSEKN

SEQ ID NO: 72420 - protein, 130 aa, Homo sapiens
  Payload ID: 14339
  Gene Symbol: RMDN1
  Gene Name: regulator of microtubule dynamics 1
  ENSP ID: ENSP00000427818
  MOD_RES (1)..(1): Any amino acid
XKTYLKLHNKKLAAFWLMKAKDYPAHTEEDKQEPDSPRVTLVRDVSPLRVRPITENKPQESLTFSFPCSPHLIVLVWIPELTAGLRCLFPHVHVYQSLKITRVFIIRIWKRSLFNQADLCLSFVFTMNSE

SEQ ID NO: 72421 - protein, 64 aa, Homo sapiens
  Payload ID: 14339
  Gene Symbol: RMDN1
  Gene Name: regulator of microtubule dynamics 1
  ENSP ID: ENSP00000428166
MGNPGTFKRGLLLSALSYLGFETYQVISQAAVVHATAKESRCVTEGRVWRCDLSSLQPLPPGFK

SEQ ID NO: 72422 - protein, 165 aa, Homo sapiens
  Payload ID: 14339
  Gene Symbol: RMDN1
  Gene Name: regulator of microtubule dynamics 1
  ENSP ID: ENSP00000428360
EEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQGKTYLKLHNKKLAAFWLMKAKDYPAHTEEDKQIQTEAAQLLTSFSEKN

SEQ ID NO: 72423 - protein, 271 aa, Homo sapiens
  Payload ID: 14339
  Gene Symbol: RMDN1
  Gene Name: regulator of microtubule dynamics 1
  Uniprot ID: Q96DB5
  ENSP ID: ENSP00000428661
MALAARLWRLLPFRRGAAPGSRLPAGTSGSRGHCGPCRFRGFEVMGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKKAIELNPKDATSIHLMGIWCYTFAEMPWYQRRIAKMLFATPPSSTYEKALGYFHRAEQGKTYLKLHNKKLAAFWLMKAKDYPAHTEEDKQIQTEAAQLLTSFSEKN

SEQ ID NO: 72424 - protein, 95 aa, Homo sapiens
  Payload ID: 14339
  Gene Symbol: RMDN1
  Gene Name: regulator of microtubule dynamics 1
  ENSP ID: ENSP00000428743
MGNPGTFKRGLLLSALSYLGFETYQVISQAAVVHATAKVEEILEQADYLYESGETEKLYQLLTQYKESEDAELLWRLARASRDVAQLSRTSEEEK

SEQ ID NO: 72425 - protein, 225 aa, Homo sapiens
  Payload ID: 14339
  Gene Symbol: RMDN1
  Gene Name: regulator of microtubule dynamics 1
  ENSP ID: ENSP00000428897
  MOD_RES (1)..(1): Any amino acid
XLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQGEEKQKQLKGQEVGLSRDVAFCWMAF

SEQ ID NO: 72426 - protein, 42 aa, Homo sapiens
  Payload ID: 14339
  Gene Symbol: RMDN1
  Gene Name: regulator of microtubule dynamics 1
  ENSP ID: ENSP00000429105
MGNPGTFKRGLLLSALSYLGFETYQVISQAAVVHATAKVRQY

SEQ ID NO: 72427 - protein, 159 aa, Homo sapiens
  Payload ID: 14339
  Gene Symbol: RMDN1
  Gene Name: regulator of microtubule dynamics 1
  ENSP ID: ENSP00000429287
  MOD_RES (1)..(1): Any amino acid
XCYTFAEMPWYQRRIAKMLFATPPSSTYEKALGYFHRAEQVDPNFYSKNLLLLGKTYLKLHNKKLAAFWLMKAKDYPAHTEEDKQEPDSPRVTLVRDVSPLRVRPITENKPQESLTFSFPCSPHLIVLVWIPELTAGLRCLFPHVHVYQRFCVASPSAS

SEQ ID NO: 72428 - protein, 248 aa, Homo sapiens
  Payload ID: 14339
  Gene Symbol: RMDN1
  Gene Name: regulator of microtubule dynamics 1
  ENSP ID: ENSP00000429899
MGNPGTFKRGLLLSALSYLGFETYQVISQAAVVHATAKVEEILEQADYLYESGETEKLYQLLTQYKESEDAELLWRLARASRDVAQLSRTSEEEKKLLVYEALEYAKRALEKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQGKTYLKLHNKKLAAFWLMKAKDYPAHTEEDKQVKRNRSS

SEQ ID NO: 72429 - protein, 108 aa, Homo sapiens
  Payload ID: 14339
  Gene Symbol: RMDN1
  Gene Name: regulator of microtubule dynamics 1
  ENSP ID: ENSP00000430559
MALAARLWRLLPFRRGAAPGSRLPAGTSGSRGHCGPCRFRGFEVMGNPGTFKRGLLLSALSYLGFETYQVISQAAVVHATAKESRCVTEGRVWRCDLSSLQPLPPGFK

SEQ ID NO: 72430 - protein, 107 aa, Homo sapiens
  Payload ID: 14339
  Gene Symbol: RMDN1
  Gene Name: regulator of microtubule dynamics 1
  ENSP ID: ENSP00000430790
  MOD_RES (1)..(1): Any amino acid
XKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQEII

SEQ ID NO: 72431 - protein, 151 aa, Homo sapiens
  Payload ID: 14339
  Gene Symbol: RMDN1
  Gene Name: regulator of microtubule dynamics 1
  ENSP ID: ENSP00000431032
  MOD_RES (1)..(1): Any amino acid
XKNESSFASHKWYAICLSDVGDYEGIKAKIANAYIIKEHFEKAIELNPKDATSIHLMGIWCYTFAEMPWYQRRIAKMLFATPPSSTYEKALGYFHRAEQVDPNFYSKNLLLLGKTYLKLHNKKLAAFWLMKAKDYPAHTEEDKQVKRNRSS

SEQ ID NO: 72432 - protein, 573 aa, Homo sapiens
  Payload ID: 14340
  Gene Symbol: RMDN2
  Gene Name: regulator of microtubule dynamics 2
  ENSP ID: ENSP00000234195
MGKCLSCCKEDQSFQRCSPEDQVSTDAQHRGASSISQPSISLGHKTSYSPVTHKVNAAKASRRLLSVSSPSFSERRYSLFVGFQKRNASPYWQQSRANFDSEEDTGFTDIKSSSDHCGSFISRRRRFSSRKLSIVSYYKSAIFFDPQASGQNVFNLNEIEIFSKTSSNTDAKKHITISAPEYNTKNFKNFETNTTSPAFGNTIDTASYQQSTSSFFSLASDISSPDQQNGIANDIQQRGQLCKDLKDFLHPRPESYSTDHSPIMIPQHPSQSGTFPFLHKAGFSSSYKNSGCFIPPQSELTSGLFEDEDFAVLFQDEDRSSPIEIPKIRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEEL

SEQ ID NO: 72433 - protein, 410 aa, Homo sapiens
  Payload ID: 14340
  Gene Symbol: RMDN2
  Gene Name: regulator of microtubule dynamics 2
  Uniprot ID: Q96LZ7
  ENSP ID: ENSP00000346549
MPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 72434 - protein, 571 aa, Homo sapiens
  Payload ID: 14340
  Gene Symbol: RMDN2
  Gene Name: regulator of microtubule dynamics 2
  ENSP ID: ENSP00000385049
MGKCLSCCKEDQSFQRCSPEDQVSTDAQHRGASSISQPSISLGHKTSYSPVTHKVNAAKASRRLLSVSSPSFSERRYSLFVGFQKRNASPYWQQSRANFDSEEDTGFTDIKSSSDHCGSFISRRRRFSSRKLSIVSYYKSAIFFDPQASGQNVFNLNEIEIFSKTSSNTDAKKHITISAPEYNTKNFKNFETNTTSPAFGNTIDTASYQQSTSSFFSLASDISSPDQQNGIANDIQQRGQLCKDLKDFLHPRPESYSTDHSPIMIPQHPSQSGTFPFLHKAGFSSSYKNSGCFIPPQSELTSGLFEDEDFAVLFQDEDRSSPIEIPKIRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKE

SEQ ID NO: 72435 - protein, 358 aa, Homo sapiens
  Payload ID: 14340
  Gene Symbol: RMDN2
  Gene Name: regulator of microtubule dynamics 2
  ENSP ID: ENSP00000385529
MGKCLSCCKEDQSFQRCSPEDQVSTDAQHRGASSISQPSISLGHKTSYSPVTHKVNAAKASRRLLSVSSPSFSERRYSLFVGFQKRNASPYWQQSRANFDSEEDTGFTDIKSSSDHCGSFISRRRRFSSRKLSIVSYYKSAIFFDPQASGQNVFNLNEIEIFSKTSSNTDAKKHITISAPEYNTKNFKNFETNTTSPAFGNTIDTASYQQSTSSFFSLASDISSPDQQNGIANDIQQRGQLCKDLKDFLHPRPESYSTDHSPIMIPQHPSQSGTFPFLHKAGFSSSYKNSGCFIPPQSELTSGLFEDEDFAVLFQDEDRSSPIEIPKIRSPQTLPSLRRAPQIVFPPVTFIACRIHFS

SEQ ID NO: 72436 - protein, 410 aa, Homo sapiens; identical to SEQ ID NO: 72433
  Payload ID: 14340
  Gene Symbol: RMDN2
  Gene Name: regulator of microtubule dynamics 2
  Uniprot ID: Q96LZ7
  ENSP ID: ENSP00000386004

SEQ ID NO: 72437 - protein, 265 aa, Homo sapiens
  Payload ID: 14340
  Gene Symbol: RMDN2
  Gene Name: regulator of microtubule dynamics 2
  Uniprot ID: Q96LZ7
  ENSP ID: ENSP00000392977
MGKCLRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 72438 - protein, 175 aa, Homo sapiens
  Payload ID: 14340
  Gene Symbol: RMDN2
  Gene Name: regulator of microtubule dynamics 2
  ENSP ID: ENSP00000393705
MPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVE

SEQ ID NO: 72439 - protein, 160 aa, Homo sapiens
  Payload ID: 14340
  Gene Symbol: RMDN2
  Gene Name: regulator of microtubule dynamics 2
  ENSP ID: ENSP00000399495
MPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGAFYGLRMTA

SEQ ID NO: 72440 - protein, 150 aa, Homo sapiens
  Payload ID: 14340
  Gene Symbol: RMDN2
  Gene Name: regulator of microtubule dynamics 2
  ENSP ID: ENSP00000406331
  MOD_RES (1)..(1): Any amino acid
XVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKRLRKTK

SEQ ID NO: 72441 - protein, 238 aa, Homo sapiens
  Payload ID: 14340
  Gene Symbol: RMDN2
  Gene Name: regulator of microtubule dynamics 2
  ENSP ID: ENSP00000416367
MGKCLRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNL

SEQ ID NO: 72442 - protein, 470 aa, Homo sapiens
  Payload ID: 14341
  Gene Symbol: RMDN3
  Gene Name: regulator of microtubule dynamics 3
  Uniprot ID: Q96TC7
  ENSP ID: ENSP00000260385
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 72443 - protein, 470 aa, Homo sapiens; identical to SEQ ID NO: 72442
  Payload ID: 14341
  Gene Symbol: RMDN3
  Gene Name: regulator of microtubule dynamics 3
  Uniprot ID: Q96TC7
  ENSP ID: ENSP00000342493

SEQ ID NO: 72444 - protein, 287 aa, Homo sapiens
  Payload ID: 14341
  Gene Symbol: RMDN3
  Gene Name: regulator of microtubule dynamics 3
  ENSP ID: ENSP00000453199
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDM

SEQ ID NO: 72445 - protein, 116 aa, Homo sapiens
  Payload ID: 14341
  Gene Symbol: RMDN3
  Gene Name: regulator of microtubule dynamics 3
  ENSP ID: ENSP00000453357
MSRLGALGGARAGLGLLLGLYADFRSRTPRDAPAGCPRWGWRCLSAAQPSTGRTGEGAGPPGLCADQPCGAAAGGGGAEKQPARACGGDCWGGPMPHGREPESGSAAKVSVCPGEE

SEQ ID NO: 72446 - protein, 306 aa, Homo sapiens
  Payload ID: 14341
  Gene Symbol: RMDN3
  Gene Name: regulator of microtubule dynamics 3
  ENSP ID: ENSP00000453535
  MOD_RES (1)..(1): Any amino acid
XESEDGEDEVSCETVKMGRKDSLDLEEEAASGASSALEAGGSSGLEDVLPLLQQADELHRGDEQGKREGFQLLLNNKLVGVGEGQGPHSPQLRKKGPHPFLSGLQYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 72447 - protein, 251 aa, Homo sapiens
  Payload ID: 14341
  Gene Symbol: RMDN3
  Gene Name: regulator of microtubule dynamics 3
  ENSP ID: ENSP00000453978
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRPLMRSSSKRHPMVSRKTSWMGPNGTLRDGACFPDATWKRTREWLGGEGFRLSGRGVTPLAPALSTSRPPREPRSQMLRVKGGKEEAEAALEKGDESADCHLWYAVLCGQLAEHESIQRRIQSGF

SEQ ID NO: 72448 - protein, 996 aa, Homo sapiens
  Payload ID: 14342
  Gene Symbol: RTEL1
  Gene Name: regulator of telomere elongation helicase 1
  Uniprot ID: Q9NZ71
  ENSP ID: ENSP00000322287
MPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 72449 - protein, 356 aa, Homo sapiens
  Payload ID: 14342
  Gene Symbol: RTEL1
  Gene Name: regulator of telomere elongation helicase 1
  ENSP ID: ENSP00000349265
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRSLLRPGHVSVMLTSSDRRGSCVSPYSSRCRATLWVLETAPPRPTVLSPTRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSP

SEQ ID NO: 72450 - protein, 1300 aa, Homo sapiens
  Payload ID: 14342
  Gene Symbol: RTEL1
  Gene Name: regulator of telomere elongation helicase 1
  Uniprot ID: Q9NZ71
  ENSP ID: ENSP00000353332
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 72451 - protein, 545 aa, Homo sapiens
  Payload ID: 14342
  Gene Symbol: RTEL1
  Gene Name: regulator of telomere elongation helicase 1
  Uniprot ID: Q9NZ71
  ENSP ID: ENSP00000359020
MPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 72452 - protein, 1219 aa, Homo sapiens
  Payload ID: 14342
  Gene Symbol: RTEL1
  Gene Name: regulator of telomere elongation helicase 1
  Uniprot ID: Q9NZ71
  ENSP ID: ENSP00000359035
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 72453 - protein, 221 aa, Homo sapiens
  Payload ID: 14342
  Gene Symbol: RTEL1
  Gene Name: regulator of telomere elongation helicase 1
  ENSP ID: ENSP00000388063
FFPSYPVMEKSLEFWRARDLARKMEALKPLFVEPRSKGSFSETISAYYARVAAPGSTGATFLAVCRGKFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPAR

SEQ ID NO: 72454 - protein, 1243 aa, Homo sapiens
  Payload ID: 14342
  Gene Symbol: RTEL1
  Gene Name: regulator of telomere elongation helicase 1
  Uniprot ID: Q9NZ71
  ENSP ID: ENSP00000424307
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRSRCRATLWVLETAPPRPTVLSPTRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 72455 - protein, 316 aa, Homo sapiens
  Payload ID: 14342
  Gene Symbol: RTEL1
  Gene Name: regulator of telomere elongation helicase 1
  ENSP ID: ENSP00000425576
VFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGNFPDALDQLCGSTSLHQEERRRIPS

SEQ ID NO: 72456 - protein, 1335 aa, Homo sapiens
  Payload ID: 14343
  Gene Symbol: RPTOR
  Gene Name: regulatory associated protein of MTOR, complex 1
  Uniprot ID: Q8N122
  ENSP ID: ENSP00000307272
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSSCQADLVKDNGHKYFLSVLADPYMPAEHRTMTAFILAVIVNSYHTGQEACLQGNLIAICLEQLNDPHPLLRQWVAICLGRIWQNFDSARWCGVRDSAHEKLYSLLSDPIPEVRCAAVFALGTFVGNSAERTDHSTTIDHNVAMMLAQLVSDGSPMVRKELVVALSHLVVQYESNFCTVALQFIEEEKNYALPSPATTEGGSLTPVRDSPCTPRLRSVSSYGNIRAVATARSLNKSLQNLSLTEESGGAVAFSPGNLSTSSSASSTLGSPENEEHILSFETIDKMRRASSYSSLNSLIGVSFNSVYTQIWRVLLHLAADPYPEVSDVAMKVLNSIAYKATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQTADDADDAAGHKSFISATVQTGFCDWSARYFAQPVMKIPEEHDLESQIRKEREWRFLRNSRVRRQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDREMKVQDIPTGADSCVTSLSCDSHRSLIVAGLGDGSIRVYDRRMALSECRVMTYREHTAWVVKASLQKRPDGHIVSVSVNGDVRIFDPRMPESVNVLQIVKGLTALDIHPQADLIACGSVNQFTAIYNSSGELINNIKYYDGFMGQRVGAISCLAFHPHWPHLAVGSNDYYISVYSVEKRVR

SEQ ID NO: 72457 - protein, 1177 aa, Homo sapiens
  Payload ID: 14343
  Gene Symbol: RPTOR
  Gene Name: regulatory associated protein of MTOR, complex 1
  Uniprot ID: Q8N122
  ENSP ID: ENSP00000442479
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSELVVALSHLVVQYESNFCTVALQFIEEEKNYALPSPATTEGGSLTPVRDSPCTPRLRSVSSYGNIRAVATARSLNKSLQNLSLTEESGGAVAFSPGNLSTSSSASSTLGSPENEEHILSFETIDKMRRASSYSSLNSLIGVSFNSVYTQIWRVLLHLAADPYPEVSDVAMKVLNSIAYKATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQTADDADDAAGHKSFISATVQTGFCDWSARYFAQPVMKIPEEHDLESQIRKEREWRFLRNSRVRRQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDREMKVQDIPTGADSCVTSLSCDSHRSLIVAGLGDGSIRVYDRRMALSECRVMTYREHTAWVVKASLQKRPDGHIVSVSVNGDVRIFDPRMPESVNVLQIVKGLTALDIHPQADLIACGSVNQFTAIYNSSGELINNIKYYDGFMGQRVGAISCLAFHPHWPHLAVGSNDYYISVYSVEKRVR

SEQ ID NO: 72458 - protein, 95 aa, Homo sapiens
  Payload ID: 14343
  Gene Symbol: RPTOR
  Gene Name: regulatory associated protein of MTOR, complex 1
  ENSP ID: ENSP00000459701
MESEMLQSPLLGLGEEDEADLTDWNLPLAFMKKRHCEKIEGSKSLAQSWRMKDRMKTVSVALVLCLNVGVDPPDVVKTTPCARLECWIGPVQAEP

SEQ ID NO: 72459 - protein, 379 aa, Homo sapiens
  Payload ID: 14343
  Gene Symbol: RPTOR
  Gene Name: regulatory associated protein of MTOR, complex 1
  Uniprot ID: Q8N122
  ENSP ID: ENSP00000460136
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMW

SEQ ID NO: 72460 - protein, 235 aa, Homo sapiens
  Payload ID: 14343
  Gene Symbol: RPTOR
  Gene Name: regulatory associated protein of MTOR, complex 1
  ENSP ID: ENSP00000460940
ATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQVREPGCLVIWTLRALLLRWGLMASASGCSHHHGMGQDPPCRPGSVGHSLPLQTRVLVLTRAPLCLHSLGALLGVSRSLCLHSLGALLGVSRFSAPGSGFTILGSFHVTKQEHGVTWLCPSWAHSTLRPLGGSCTAEHLF

SEQ ID NO: 72461 - protein, 979 aa, Homo sapiens
  Payload ID: 14344
  Gene Symbol: RFX1
  Gene Name: regulatory factor X, 1 (influences HLA class II expression)
  Uniprot ID: P22670
  ENSP ID: ENSP00000254325
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQRLLVQTSVQAKPGHVSPLQLTNIQVPQQALPTQRLVVQSAAPGSKGGQVSLTVHGTQQVHSPPEQSPVQANSSSSKTAGAPTGTVPQQLQVHGVQQSVPVTQERSVVQATPQAPKPGPVQPLTVQGLQPVHVAQEVQQLQQVPVPHVYSSQVQYVEGGDASYTASAIRSSTYSYPETPLYTQTASTSYYEAAGTATQVSTPATSQAVASSGSMPMYVSGSQVVASSTSTGAGASNSSGGGGSGGGGGGGGGGGGGGSGSTGGGGSGAGTYVIQGGYMLGSASQSYSHTTRASPATVQWLLDNYETAEGVSLPRSTLYCHYLLHCQEQKLEPVNAASFGKLIRSVFMGLRTRRLGTRGNSKYHYYGLRIKASSPLLRLMEDQQHMAMRGQPFSQKQRLKPIQKMEGMTNGVAVGQQPSTGLSDISAQVQQYQQFLDASRSLPDFTELDLQGKVLPEGVGPGDIKAFQVLYREHCEAIVDVMVNLQFTLVETLWKTFWRYNLSQPSEAPPLAVHDEAEKRLPKAILVLLSKFEPVLQWTKHCDNVLYQGLVEILIPDVLRPIPSALTQAIRNFAKSLESWLTHAMVNIPEEMLRVKVAAAGAFAQTLRRYTSLNHLAQAARAVLQNTAQINQMLSDLNRVDFANVQEQASWVCRCEDRVVQRLEQDFKVTLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 72462 - protein, 158 aa, Homo sapiens
  Payload ID: 14344
  Gene Symbol: RFX1
  Gene Name: regulatory factor X, 1 (influences HLA class II expression)
  ENSP ID: ENSP00000464960
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQMCTAAARHPTTPGLP

SEQ ID NO: 72463 - protein, 723 aa, Homo sapiens
  Payload ID: 14345
  Gene Symbol: RFX2
  Gene Name: regulatory factor X, 2 (influences HLA class II expression)
  Uniprot ID: P48378
  ENSP ID: ENSP00000306335
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLEMAIENLQKSEGITSHKSGLLNSHLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 72464 - protein, 723 aa, Homo sapiens; identical to SEQ ID NO: 72463
  Payload ID: 14345
  Gene Symbol: RFX2
  Gene Name: regulatory factor X, 2 (influences HLA class II expression)
  Uniprot ID: P48378
  ENSP ID: ENSP00000352076

SEQ ID NO: 72465 - protein, 142 aa, Homo sapiens
  Payload ID: 14345
  Gene Symbol: RFX2
  Gene Name: regulatory factor X, 2 (influences HLA class II expression)
  ENSP ID: ENSP00000464826
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGS

SEQ ID NO: 72466 - protein, 33 aa, Homo sapiens
  Payload ID: 14345
  Gene Symbol: RFX2
  Gene Name: regulatory factor X, 2 (influences HLA class II expression)
  ENSP ID: ENSP00000465122
MGLRTRRLGTRGNSKYHYYGIRLKPDSPLNRLQ

SEQ ID NO: 72467 - protein, 99 aa, Homo sapiens
  Payload ID: 14345
  Gene Symbol: RFX2
  Gene Name: regulatory factor X, 2 (influences HLA class II expression)
  ENSP ID: ENSP00000465135
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQM

SEQ ID NO: 72468 - protein, 180 aa, Homo sapiens
  Payload ID: 14345
  Gene Symbol: RFX2
  Gene Name: regulatory factor X, 2 (influences HLA class II expression)
  ENSP ID: ENSP00000466028
  MOD_RES (1)..(1): Any amino acid
XDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSGRRQCLRPDAAALHVPQPPGAGGPGGAAEHVPDQPDAQRPQPRGLCQRA

SEQ ID NO: 72469 - protein, 98 aa, Homo sapiens
  Payload ID: 14345
  Gene Symbol: RFX2
  Gene Name: regulatory factor X, 2 (influences HLA class II expression)
  ENSP ID: ENSP00000466177
MGLRTRRLGTRYRPAQKTDSLGDSGSHSGLHSTPEQTMAVQSQHHQQYIDVSHVFPEFPAPDLGSFLLQDGVTLHDVKALQLVYRRHCEATVDVVMNL

SEQ ID NO: 72470 - protein, 93 aa, Homo sapiens
  Payload ID: 14345
  Gene Symbol: RFX2
  Gene Name: regulatory factor X, 2 (influences HLA class II expression)
  ENSP ID: ENSP00000466890
MQPISLPRVQQVPQQVQPVQHVYPAQVQYVEGGDAVYTNGAIRTAYTYNPEPQMYAPSSTASYFEAPGGAQVTVAASSPPAVPSHSMVGITMD

SEQ ID NO: 72471 - protein, 698 aa, Homo sapiens
  Payload ID: 14345
  Gene Symbol: RFX2
  Gene Name: regulatory factor X, 2 (influences HLA class II expression)
  Uniprot ID: P48378
  ENSP ID: ENSP00000467166
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 72472 - protein, 147 aa, Homo sapiens
  Payload ID: 14345
  Gene Symbol: RFX2
  Gene Name: regulatory factor X, 2 (influences HLA class II expression)
  ENSP ID: ENSP00000467736
MAIENLQKSEGITSHKSGLLNSHLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTP

SEQ ID NO: 72473 - protein, 169 aa, Homo sapiens
  Payload ID: 14345
  Gene Symbol: RFX2
  Gene Name: regulatory factor X, 2 (influences HLA class II expression)
  ENSP ID: ENSP00000467979
MQNSEGGADSPASVALRPSAAAPPVPASPQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLEMAIENLQKSEGITSHKSGLLNSH

SEQ ID NO: 72474 - protein, 110 aa, Homo sapiens
  Payload ID: 14345
  Gene Symbol: RFX2
  Gene Name: regulatory factor X, 2 (influences HLA class II expression)
  ENSP ID: ENSP00000468036
MQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHG

SEQ ID NO: 72475 - protein, 105 aa, Homo sapiens
  Payload ID: 14345
  Gene Symbol: RFX2
  Gene Name: regulatory factor X, 2 (influences HLA class II expression)
  ENSP ID: ENSP00000468561
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSST

SEQ ID NO: 72476 - protein, 413 aa, Homo sapiens
  Payload ID: 14346
  Gene Symbol: RFX3
  Gene Name: regulatory factor X, 3 (influences HLA class II expression)
  Uniprot ID: P48380
  ENSP ID: ENSP00000303847
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESRSESTSFPIHFHG

SEQ ID NO: 72477 - protein, 707 aa, Homo sapiens
  Payload ID: 14346
  Gene Symbol: RFX3
  Gene Name: regulatory factor X, 3 (influences HLA class II expression)
  Uniprot ID: P48380
  ENSP ID: ENSP00000351574
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESSNLSEIESRLPKAKLITLCKHESILKWMCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEVREAERAVTHWVIKNKPELHFSLNTLLIKTMVPNQVSLRARRDCGVIARVP

SEQ ID NO: 72478 - protein, 85 aa, Homo sapiens
  Payload ID: 14346
  Gene Symbol: RFX3
  Gene Name: regulatory factor X, 3 (influences HLA class II expression)
  ENSP ID: ENSP00000371414
MQTSETGSDTGSTVTLQTSVASQAAVPTQVVQQVPVQQQVQQVQTVQQVQHVYPAQVQYVEGSDTVYTNGAMSRAPWSMILESSP

SEQ ID NO: 72479 - protein, 749 aa, Homo sapiens
  Payload ID: 14346
  Gene Symbol: RFX3
  Gene Name: regulatory factor X, 3 (influences HLA class II expression)
  Uniprot ID: P48380
  ENSP ID: ENSP00000371434
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESSNLSEIESRLPKAKLITLCKHESILKWMCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEFGDLNAVSPGNLDKDEGSEVESEMDEELDDSSEPQAKREKTELSQAFPVGCMQPVLETGVQPSLLNPIHSEHIVTSTQTIRQCSATGNTYTAV

SEQ ID NO: 72480 - protein, 138 aa, Homo sapiens
  Payload ID: 14346
  Gene Symbol: RFX3
  Gene Name: regulatory factor X, 3 (influences HLA class II expression)
  ENSP ID: ENSP00000399352
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIG

SEQ ID NO: 72481 - protein, 174 aa, Homo sapiens
  Payload ID: 14346
  Gene Symbol: RFX3
  Gene Name: regulatory factor X, 3 (influences HLA class II expression)
  ENSP ID: ENSP00000400026
MCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKW

SEQ ID NO: 72482 - protein, 216 aa, Homo sapiens
  Payload ID: 14346
  Gene Symbol: RFX3
  Gene Name: regulatory factor X, 3 (influences HLA class II expression)
  ENSP ID: ENSP00000405664
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATLQWLLDNYETAEGVSLPRSTLYNHYLRHCQEHKLDPVNAASFGKLIRSIFMGLRTRRL

SEQ ID NO: 72483 - protein, 135 aa, Homo sapiens
  Payload ID: 14346
  Gene Symbol: RFX3
  Gene Name: regulatory factor X, 3 (influences HLA class II expression)
  ENSP ID: ENSP00000410988
VQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATLFLFSCVPFSLGQLSP

SEQ ID NO: 72484 - protein, 184 aa, Homo sapiens
  Payload ID: 14346
  Gene Symbol: RFX3
  Gene Name: regulatory factor X, 3 (influences HLA class II expression)
  ENSP ID: ENSP00000411756
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHV

SEQ ID NO: 72485 - protein, 124 aa, Homo sapiens
  Payload ID: 14346
  Gene Symbol: RFX3
  Gene Name: regulatory factor X, 3 (influences HLA class II expression)
  ENSP ID: ENSP00000415594
EQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEVPM

SEQ ID NO: 72486 - protein, 156 aa, Homo sapiens
  Payload ID: 14346
  Gene Symbol: RFX3
  Gene Name: regulatory factor X, 3 (influences HLA class II expression)
  ENSP ID: ENSP00000416189
VQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATANSVPEMKLLRQITMNRLFPTLNHKLTEGSGPHFQSI

SEQ ID NO: 72487 - protein, 749 aa, Homo sapiens; identical to SEQ ID NO: 72479
  Payload ID: 14346
  Gene Symbol: RFX3
  Gene Name: regulatory factor X, 3 (influences HLA class II expression)
  Uniprot ID: P48380
  ENSP ID: ENSP00000482598

SEQ ID NO: 72488 - protein, 641 aa, Homo sapiens
  Payload ID: 14347
  Gene Symbol: RFX4
  Gene Name: regulatory factor X, 4 (influences HLA class II expression)
  Uniprot ID: Q33E94
  ENSP ID: ENSP00000229387
MNWAAFGGSEFFIPEGIQIDSRCPLSRNITEWYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 72489 - protein, 744 aa, Homo sapiens
  Payload ID: 14347
  Gene Symbol: RFX4
  Gene Name: regulatory factor X, 4 (influences HLA class II expression)
  Uniprot ID: Q33E94
  ENSP ID: ENSP00000350552
MIKRRAHPGAGGDRTRPRRRRSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 72490 - protein, 735 aa, Homo sapiens
  Payload ID: 14347
  Gene Symbol: RFX4
  Gene Name: regulatory factor X, 4 (influences HLA class II expression)
  Uniprot ID: Q33E94
  ENSP ID: ENSP00000376585
MHCGLLEEPDMDSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 72491 - protein, 247 aa, Homo sapiens
  Payload ID: 14347
  Gene Symbol: RFX4
  Gene Name: regulatory factor X, 4 (influences HLA class II expression)
  ENSP ID: ENSP00000444163
MIKRRAHPGAGGDRTRPRRRRSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEECRPTCCLCWAPPRW

SEQ ID NO: 72492 - protein, 77 aa, Homo sapiens
  Payload ID: 14347
  Gene Symbol: RFX4
  Gene Name: regulatory factor X, 4 (influences HLA class II expression)
  ENSP ID: ENSP00000447423
MHCGLLEEPDMDSTDEEKENNRASKPHSTPATLQWLEENYEIAEGVCIPRSALYMHYLDFCEKNDTQPVNAASFGKQ

SEQ ID NO: 72493 - protein, 59 aa, Homo sapiens
  Payload ID: 14347
  Gene Symbol: RFX4
  Gene Name: regulatory factor X, 4 (influences HLA class II expression)
  ENSP ID: ENSP00000447735
MHYLDFCEKNDTQPVNAASFGKIIRQQFPQLTTRRLGTRGQSKYHYYGIAVKESSQYYD

SEQ ID NO: 72494 - protein, 256 aa, Homo sapiens
  Payload ID: 14347
  Gene Symbol: RFX4
  Gene Name: regulatory factor X, 4 (influences HLA class II expression)
  ENSP ID: ENSP00000448694
MTSATDGERLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFE

SEQ ID NO: 72495 - protein, 39 aa, Homo sapiens
  Payload ID: 14347
  Gene Symbol: RFX4
  Gene Name: regulatory factor X, 4 (influences HLA class II expression)
  ENSP ID: ENSP00000449732
MNWAAFGGSEFFIPEGIQIDSRCPLSRNITECERKLPIL

SEQ ID NO: 72496 - protein, 145 aa, Homo sapiens
  Payload ID: 14347
  Gene Symbol: RFX4
  Gene Name: regulatory factor X, 4 (influences HLA class II expression)
  ENSP ID: ENSP00000473326
MPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQ

SEQ ID NO: 72497 - protein, 616 aa, Homo sapiens
  Payload ID: 14348
  Gene Symbol: RFX5
  Gene Name: regulatory factor X, 5 (influences HLA class II expression)
  Uniprot ID: P48382
  ENSP ID: ENSP00000290524
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 72498 - protein, 616 aa, Homo sapiens; identical to SEQ ID NO: 72497
  Payload ID: 14348
  Gene Symbol: RFX5
  Gene Name: regulatory factor X, 5 (influences HLA class II expression)
  Uniprot ID: P48382
  ENSP ID: ENSP00000357864

SEQ ID NO: 72499 - protein, 596 aa, Homo sapiens
  Payload ID: 14348
  Gene Symbol: RFX5
  Gene Name: regulatory factor X, 5 (influences HLA class II expression)
  ENSP ID: ENSP00000376502
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLK

SEQ ID NO: 72500 - protein, 123 aa, Homo sapiens
  Payload ID: 14348
  Gene Symbol: RFX5
  Gene Name: regulatory factor X, 5 (influences HLA class II expression)
  ENSP ID: ENSP00000387618
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCES

SEQ ID NO: 72501 - protein, 616 aa, Homo sapiens; identical to SEQ ID NO: 72497
  Payload ID: 14348
  Gene Symbol: RFX5
  Gene Name: regulatory factor X, 5 (influences HLA class II expression)
  Uniprot ID: P48382
  ENSP ID: ENSP00000389130

SEQ ID NO: 72502 - protein, 96 aa, Homo sapiens
  Payload ID: 14348
  Gene Symbol: RFX5
  Gene Name: regulatory factor X, 5 (influences HLA class II expression)
  ENSP ID: ENSP00000390720
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWI

SEQ ID NO: 72503 - protein, 235 aa, Homo sapiens
  Payload ID: 14348
  Gene Symbol: RFX5
  Gene Name: regulatory factor X, 5 (influences HLA class II expression)
  ENSP ID: ENSP00000390769
PKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQEVHSPLYRQLSHPVYLVPGCCL

SEQ ID NO: 72504 - protein, 117 aa, Homo sapiens
  Payload ID: 14348
  Gene Symbol: RFX5
  Gene Name: regulatory factor X, 5 (influences HLA class II expression)
  ENSP ID: ENSP00000396810
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAY

SEQ ID NO: 72505 - protein, 184 aa, Homo sapiens
  Payload ID: 14348
  Gene Symbol: RFX5
  Gene Name: regulatory factor X, 5 (influences HLA class II expression)
  ENSP ID: ENSP00000398666
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSE

SEQ ID NO: 72506 - protein, 229 aa, Homo sapiens
  Payload ID: 14348
  Gene Symbol: RFX5
  Gene Name: regulatory factor X, 5 (influences HLA class II expression)
  ENSP ID: ENSP00000399095
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARF

SEQ ID NO: 72507 - protein, 44 aa, Homo sapiens
  Payload ID: 14348
  Gene Symbol: RFX5
  Gene Name: regulatory factor X, 5 (influences HLA class II expression)
  ENSP ID: ENSP00000399372
MAEDEPDAKSPKTGGRAPPGGAEAGEPTTLLQRLRGTISPCRTK

SEQ ID NO: 72508 - protein, 50 aa, Homo sapiens
  Payload ID: 14348
  Gene Symbol: RFX5
  Gene Name: regulatory factor X, 5 (influences HLA class II expression)
  ENSP ID: ENSP00000405067
MAEDEPDAKSPKTGGRAPPGGAEAGEPTTLLQRLRGTISKAVQNKVEGIL

SEQ ID NO: 72509 - protein, 165 aa, Homo sapiens
  Payload ID: 14348
  Gene Symbol: RFX5
  Gene Name: regulatory factor X, 5 (influences HLA class II expression)
  ENSP ID: ENSP00000409187
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIR

SEQ ID NO: 72510 - protein, 50 aa, Homo sapiens; identical to SEQ ID NO: 72508
  Payload ID: 14348
  Gene Symbol: RFX5
  Gene Name: regulatory factor X, 5 (influences HLA class II expression)
  ENSP ID: ENSP00000412900

SEQ ID NO: 72511 - protein, 105 aa, Homo sapiens
  Payload ID: 14348
  Gene Symbol: RFX5
  Gene Name: regulatory factor X, 5 (influences HLA class II expression)
  ENSP ID: ENSP00000413153
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTD

SEQ ID NO: 72512 - protein, 42 aa, Homo sapiens
  Payload ID: 14348
  Gene Symbol: RFX5
  Gene Name: regulatory factor X, 5 (influences HLA class II expression)
  ENSP ID: ENSP00000415012
MAEDEPDAKSPKTGGRAPPGGAEAGEPTTLLQRLRARPCRTK

SEQ ID NO: 72513 - protein, 928 aa, Homo sapiens
  Payload ID: 14349
  Gene Symbol: RFX6
  Gene Name: regulatory factor X, 6
  Uniprot ID: Q8HWS3
  ENSP ID: ENSP00000332208
MAKVPELEDTFLQAQPAPQLSPGIQEDCCVQLLGKGLLVYPEETVYLAAEGQPGGEQGGGEKGEDPELPGAVKSEMHLNNGNFSSEEEDADNHDSKTKAADQYLSQKKTITQIVKDKKKQTQLTLQWLEENYIVCEGVCLPRCILYAHYLDFCRKEKLEPACAATFGKTIRQKFPLLTTRRLGTRGHSKYHYYGIGIKESSAYYHSVYSGKGLTRFSGSKLKNEGGFTRKYSLSSKTGTLLPEFPSAQHLVYQGCISKDKVDTLIMMYKTHCQCILDNAINGNFEEIQHFLLHFWQGMPDHLLPLLENPVIIDIFCVCDSILYKVLTDVLIPATMQEMPESLLADIRNFAKNWEQWVVSSLENLPEALTDKKIPIVRRFVSSLKRQTSFLHLAQIARPALFDQHVVNSMVSDIERVDLNSIGSQALLTISGSTDTESGIYTEHDSITVFQELKDLLKKNATVEAFIEWLDTVVEQRVIKTSKQNGRSLKKRAQDFLLKWSFFGARVMHNLTLNNASSFGSFHLIRMLLDEYILLAMETQFNNDKEQELQNLLDKYMKNSDASKAAFTASPSSCFLANRNKGSMVSSDAVKNESHVETTYLPLPSSQPGGLGPALHQFPAGNTDNMPLTGQMELSQIAGHLMTPPISPAMASRGSVINQGPMAGRPPSVGPVLSAPSHCSTYPEPIYPTLPQANHDFYSTSSNYQTVFRAQPHSTSGLYPHHTEHGRCMAWTEQQLSRDFFSGSCAGSPYNSRPPSSYGPSLQAQDSHNMQFLNTGSFNFLSNTGAASCQGATLPPNSPNGYYGSNINYPESHRLGSMVNQHVSVISSIRSLPPYSDIHDPLNILDDSGRKQTSSFYTDTSSPVACRTPVLASSLQTPIPSSSSQCMYGTSNQYPAQETLDSHGTSSREMVSSLPPINTVFMGTAAGGT

SEQ ID NO: 72514 - protein, 1363 aa, Homo sapiens
  Payload ID: 14350
  Gene Symbol: RFX7
  Gene Name: regulatory factor X, 7
  Uniprot ID: Q2KHR2
  ENSP ID: ENSP00000453281
MSSSRAQQMHAFSWIRNTLEEHPETSLPKQEVYDEYKSYCDNLGYHPLSAADFGKIMKNVFPNMKARRLGTRGKSKYCYSGLRKKAFVHMPTLPNLDFHKTGDGLEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSVKQAPKTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTHFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLVGQGASDLTNTASDFSSDIRLSSELSGSINDLNTLDPNLLFDPGRQQGQDDEATLEELKNDPLFQQICSESMNSMTSSGFEWIESKDHPTVEMLG

SEQ ID NO: 72515 - protein, 1276 aa, Homo sapiens
  Payload ID: 14350
  Gene Symbol: RFX7
  Gene Name: regulatory factor X, 7
  ENSP ID: ENSP00000453376
MSSSRAQQMHAFSWIRNTLEEHPETSLPKQEVYDEYKSYCDNLGYHPLSAADFGKIMKNVFPNMKARRLGTRGKSKYCYSGLRKKAFVHMPTLPNLDFHKTGDGLEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSVKQAPKTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTHFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLKYPDVLGE

SEQ ID NO: 72516 - protein, 76 aa, Homo sapiens
  Payload ID: 14350
  Gene Symbol: RFX7
  Gene Name: regulatory factor X, 7
  ENSP ID: ENSP00000453611
MSSSRAQQMHAFSWIRNTLEEHPETSLPKQEVYDEYKSYCDNLGYHPLSAADFGKIMKNVFPNMKARRLGTRGKSK

SEQ ID NO: 72517 - protein, 260 aa, Homo sapiens
  Payload ID: 14351
  Gene Symbol: RFXANK
  Gene Name: regulatory factor X-associated ankyrin-containing protein
  Uniprot ID: O14593
  ENSP ID: ENSP00000305071
MELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLVPADPE

SEQ ID NO: 72518 - protein, 237 aa, Homo sapiens
  Payload ID: 14351
  Gene Symbol: RFXANK
  Gene Name: regulatory factor X-associated ankyrin-containing protein
  ENSP ID: ENSP00000376138
MELTQPAEDLIQTQQTPASELGDPEDPGEEAADGSDTVVLSLFPCTPEPVNPEPDASVSSPQGSSLKHSTTLTNRQRGNEVSALPATLDCDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLVPADPE

SEQ ID NO: 72519 - protein, 260 aa, Homo sapiens; identical to SEQ ID NO: 72517
  Payload ID: 14351
  Gene Symbol: RFXANK
  Gene Name: regulatory factor X-associated ankyrin-containing protein
  Uniprot ID: O14593
  ENSP ID: ENSP00000384572

SEQ ID NO: 72520 - protein, 83 aa, Homo sapiens
  Payload ID: 14351
  Gene Symbol: RFXANK
  Gene Name: regulatory factor X-associated ankyrin-containing protein
  ENSP ID: ENSP00000393159
MELTQPAEDLIQTQQTPASELGDPEDPGEEAADGSDTVVLSLFPCTPEPVNPEPDASVSSPQAGSSLKHSTTLTNRQRGNEVS

SEQ ID NO: 72521 - protein, 238 aa, Homo sapiens
  Payload ID: 14351
  Gene Symbol: RFXANK
  Gene Name: regulatory factor X-associated ankyrin-containing protein
  Uniprot ID: O14593
  ENSP ID: ENSP00000409138
MELTQPAEDLIQTQQTPASELGDPEDPGEEAADGSDTVVLSLFPCTPEPVNPEPDASVSSPQAGSSLKHSTTLTNRQRGNEVSALPATLDCDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLVPADPE

SEQ ID NO: 72522 - protein, 41 aa, Homo sapiens
  Payload ID: 14351
  Gene Symbol: RFXANK
  Gene Name: regulatory factor X-associated ankyrin-containing protein
  ENSP ID: ENSP00000440321
PEALTSPPKPTLATPRWTLPWPWDTGKMEFRSCCPGWSAMA

SEQ ID NO: 72523 - protein, 188 aa, Homo sapiens
  Payload ID: 14351
  Gene Symbol: RFXANK
  Gene Name: regulatory factor X-associated ankyrin-containing protein
  ENSP ID: ENSP00000440325
MELTQPAEDLIQTQQTPASELGDPEDPGEEAADGSDTVVLSLFPCTPEPVNPEPDASVSSPQAGSSLKHSTTLTNRQRGNEVSALPATLDCDNLVNKPDERGFTPLIWASAFGEIETVRFLLEWGADPHILAKERESALSLASTGGYTDIVGLLLERDVDINIYDWNGGTPLLYAVRGNHVKCVEALL

SEQ ID NO: 72524 - protein, 47 aa, Homo sapiens
  Payload ID: 14351
  Gene Symbol: RFXANK
  Gene Name: regulatory factor X-associated ankyrin-containing protein
  ENSP ID: ENSP00000441042
PEALTSPPKPTLATPRWTLPWPWDTGKVIENHILKLFQSNLVPADPE

SEQ ID NO: 72525 - protein, 182 aa, Homo sapiens
  Payload ID: 14351
  Gene Symbol: RFXANK
  Gene Name: regulatory factor X-associated ankyrin-containing protein
  ENSP ID: ENSP00000444280
DTVVLSLFPCTPEPVNPEPDASVSSPQAGSSLKHSTTLTNRQRGNEVSALPATLDCDNLVNKPDERGFTPLIWASAFGEIETVRFLLEWGADPHILAKERESALSLASTGGYTDIVGLLLERDVDINIYDWNGGTPLLYAVRGNHVKCVEALLETLQPRSSVETKIAEPEALTSPPKPTLAT

SEQ ID NO: 72526 - protein, 145 aa, Homo sapiens
  Payload ID: 14351
  Gene Symbol: RFXANK
  Gene Name: regulatory factor X-associated ankyrin-containing protein
  ENSP ID: ENSP00000466913
MELTQPAEDLIQTQQTPASELGDPEDPGEEAADGSDTVVLSLFPCTPEPVNPEPDASVSSPQGSSLKHSTTLTNRQRGNEVSALPATLDSLSIHQLAAQGELDQLKEHLRKGDNLVNKPDERGFTPLIWASAFGEIETVRFLLEW

SEQ ID NO: 72527 - protein, 272 aa, Homo sapiens
  Payload ID: 14352
  Gene Symbol: RFXAP
  Gene Name: regulatory factor X-associated protein
  Uniprot ID: O00287
  ENSP ID: ENSP00000255476
MEAQGVAEGAGPGAASGVPHPAALAPAAAPTLAPASVAAAASQFTLLVMQPCAGQDEAAAPGGSVGAGKPVRYLCEGAGDGEEEAGEDEADLLDTSDPPGGGESAASLEDLEDEETHSGGEGSSGGARRRGSGGGSMSKTCTYEGCSETTSQVAKQRKPWMCKKHRNKMYKDKYKKKKSDQALNCGGTASTGSAGNVKLEESADNILSIVKQRTGSFGDRPARPTLLEQVLNQKRLSLLRSPEVVQFLQKQQQLLNQQVLEQRQQQFPGTSM

SEQ ID NO: 72528 - protein, 617 aa, Homo sapiens
  Payload ID: 14353
  Gene Symbol: RSC1A1
  Gene Name: regulatory solute carrier protein, family 1, member 1
  Uniprot ID: Q92681
  ENSP ID: ENSP00000341963
MSSLPTSDGFNHPARSSGQSPDVGNPMSLARSVSASVCPIKPSDSDRIEPKAVKALKASAEFQLNSEKKEHLSLQDLSDHASSADHAPTDQSPAMPMQNSSEEITVAGNLEKSAERSTQGLKFHLHTRQEASLSVTSTRMHEPQMFLGEKDWHPENQNLSQVSDPQQHEEPGNEQYEVAQQKASHDQEYLCNIGDLELPEERQQNQHKIVDLEATMKGNGLPQNVDPPSAKKSIPSSECSGCSNSETFMEIDTAQQSLVTLLNSTGRQNANVKNIGALDLTLDNPLMEVETSKCNPSSEILNDSISTQDLQPPETNVEIPGTNKEYGHYSSPSLCGSCQPSVESAEESCPSITAALKELHELLVVSSKPASENTSEEVICQSETIAEGQTSIKDLSERWTQNEHLTQNEQCPQVSFHQAISVSVETEKLTGTSSDTGREAVENVNFRSLGDGLSTDKEGVPKSRESINKNRSVTVTSAKTSNQLHCTLGVEISPKLLAGEEDALNQTSEQTKSLSSNFILVKDLGQGIQNSVTDRPETRENVCPDASRPLLEYEPPTSHPSSSPAILPPLIFPATDIDRILRAGFTLQEALGALHRVGGNADLALLVLLAKNIVVPT

SEQ ID NO: 72529 - protein, 92 aa, Homo sapiens
  Payload ID: 14354
  Gene Symbol: RIIAD1
  Gene Name: regulatory subunit of type II PKA R-subunit (RIIa) domain containing 1
  Uniprot ID: A6NNX1
  ENSP ID: ENSP00000419249
METLPGLLQRPDPGALSAAQLEQLRKFKIQTRIANEKYLRTHKEVEWLISGFFREIFLKRPDNILEFAADYFTDPRLPNKIHMQLIKDKKAA

SEQ ID NO: 72530 - protein, 102 aa, Homo sapiens
  Payload ID: 14354
  Gene Symbol: RIIAD1
  Gene Name: regulatory subunit of type II PKA R-subunit (RIIa) domain containing 1
  ENSP ID: ENSP00000420280
MLSVRRVSEDICSRIYESAQRIDSITFLPSSGFHLKWKIQTRIANEKYLRTHKEVEWLISGFFREIFLKRPDNILEFAADYFTDPRLPNKIHMQLIKDKKAA

SEQ ID NO: 72531 - protein, 218 aa, Homo sapiens
  Payload ID: 14355
  Gene Symbol: RRAS
  Gene Name: related RAS viral (r-ras) oncogene homolog
  Uniprot ID: P10301
  ENSP ID: ENSP00000246792
MSSGAASGTGRGRPRGGGPGPGDPPPSETHKLVVVGGGGVGKSALTIQFIQSYFVSDYDPTIEDSYTKICSVDGIPARLDILDTAGQEEFGAMREQYMRAGHGFLLVFAINDRQSFNEVGKLFTQILRVKDRDDFPVVLVGNKADLESQRQVPRSEASAFGASHHVAYFEASAKLRLNVDEAFEQLVRAVRKYQEQELPPSPPSAPRKKGGGCPCVLL

SEQ ID NO: 72532 - protein, 204 aa, Homo sapiens
  Payload ID: 14356
  Gene Symbol: RRAS2
  Gene Name: related RAS viral (r-ras) oncogene homolog 2
  Uniprot ID: P62070
  ENSP ID: ENSP00000256196
MAAAGWRDGSGQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 72533 - protein, 127 aa, Homo sapiens
  Payload ID: 14356
  Gene Symbol: RRAS2
  Gene Name: related RAS viral (r-ras) oncogene homolog 2
  Uniprot ID: P62070
  ENSP ID: ENSP00000403282
MREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 72534 - protein, 127 aa, Homo sapiens; identical to SEQ ID NO: 72533
  Payload ID: 14356
  Gene Symbol: RRAS2
  Gene Name: related RAS viral (r-ras) oncogene homolog 2
  Uniprot ID: P62070
  ENSP ID: ENSP00000431954

SEQ ID NO: 72535 - protein, 69 aa, Homo sapiens
  Payload ID: 14356
  Gene Symbol: RRAS2
  Gene Name: related RAS viral (r-ras) oncogene homolog 2
  ENSP ID: ENSP00000432559
MREQYMRTGEGFLLVFSVTDRGSFEEIYKFQRQILRVKDRDEFPMILIGNKADLDHQRQVTQEEGQQLA

SEQ ID NO: 72536 - protein, 127 aa, Homo sapiens; identical to SEQ ID NO: 72533
  Payload ID: 14356
  Gene Symbol: RRAS2
  Gene Name: related RAS viral (r-ras) oncogene homolog 2
  Uniprot ID: P62070
  ENSP ID: ENSP00000433230

SEQ ID NO: 72537 - protein, 127 aa, Homo sapiens; identical to SEQ ID NO: 72533
  Payload ID: 14356
  Gene Symbol: RRAS2
  Gene Name: related RAS viral (r-ras) oncogene homolog 2
  Uniprot ID: P62070
  ENSP ID: ENSP00000434104

SEQ ID NO: 72538 - protein, 166 aa, Homo sapiens
  Payload ID: 14356
  Gene Symbol: RRAS2
  Gene Name: related RAS viral (r-ras) oncogene homolog 2
  ENSP ID: ENSP00000435453
MQESSIILQMFCFLSRESYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPP

SEQ ID NO: 72539 - protein, 47 aa, Homo sapiens
  Payload ID: 14356
  Gene Symbol: RRAS2
  Gene Name: related RAS viral (r-ras) oncogene homolog 2
  ENSP ID: ENSP00000436190
MAAAGWRDGSGQEKYRLVVVGGGGVGKSALTIQFIQNHLLKKYLHCE

SEQ ID NO: 72540 - protein, 52 aa, Homo sapiens
  Payload ID: 14356
  Gene Symbol: RRAS2
  Gene Name: related RAS viral (r-ras) oncogene homolog 2
  ENSP ID: ENSP00000436887
MAAAGWRDGSGQEKYRLVVVGGGGVGKSALTIQFIQVFRNSWVPSFIHVFQI

SEQ ID NO: 72541 - protein, 127 aa, Homo sapiens; identical to SEQ ID NO: 72533
  Payload ID: 14356
  Gene Symbol: RRAS2
  Gene Name: related RAS viral (r-ras) oncogene homolog 2
  Uniprot ID: P62070
  ENSP ID: ENSP00000437083

SEQ ID NO: 72542 - protein, 169 aa, Homo sapiens
  Payload ID: 14356
  Gene Symbol: RRAS2
  Gene Name: related RAS viral (r-ras) oncogene homolog 2
  Uniprot ID: P62070
  ENSP ID: ENSP00000437547
MSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 72543 - protein, 203 aa, Homo sapiens
  Payload ID: 14356
  Gene Symbol: RRAS2
  Gene Name: related RAS viral (r-ras) oncogene homolog 2
  ENSP ID: ENSP00000441722
MAAAAGGRLRQEKYRLVVVGGGGVGKSALTIQFIQSYFVTDYDPTIEDSYTKQCVIDDRAARLDILDTAGQEEFGAMREQYMRTGEGFLLVFSVTDRGSFEEIYKFQRQILRVKDRDEFPMILIGNKADLDHQRQVTQEEGQQLARQLKVTYMEASAKIRMNVDQAFHELVRVIRKFQEQECPPSPEPTRKEKDKKGCHCVIF

SEQ ID NO: 72544 - protein, 185 aa, Homo sapiens
  Payload ID: 14357
  Gene Symbol: RLN1
  Gene Name: relaxin 1
  Uniprot ID: P04808
  ENSP ID: ENSP00000223862
MPRLFLFHLLEFCLLLNQFSRAVAAKWKDDVIKLCGRELVRAQIAICGMSTWSKRSLSQEDAPQTPRPVAEIVPSFINKDTETIIIMLEFIANLPPELKAALSERQPSLPELQQYVPALKDSNLSFEEFKKLIRNRQSEAADSNPSELKYLGLDTHSQKKRRPYVALFEKCCLIGCTKRSLAKYC

SEQ ID NO: 72545 - protein, 185 aa, Homo sapiens
  Payload ID: 14358
  Gene Symbol: RLN2
  Gene Name: relaxin 2
  Uniprot ID: P04090
  ENSP ID: ENSP00000371040
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 72546 - protein, 68 aa, Homo sapiens
  Payload ID: 14358
  Gene Symbol: RLN2
  Gene Name: relaxin 2
  ENSP ID: ENSP00000399616
  MOD_RES (1)..(1): Any amino acid
XTWSKRSLSQEDAPQTPRPVAGDFIQTVSLGISPDGGKALRTGSCFTREFLGALSKLCHPSSTKIQKP

SEQ ID NO: 72547 - protein, 142 aa, Homo sapiens
  Payload ID: 14359
  Gene Symbol: RLN3
  Gene Name: relaxin 3
  Uniprot ID: Q8WXF3
  ENSP ID: ENSP00000397415
MARYMLLLLLAVWVLTGELWPGAEARAAPYGVRLCGREFIRAVIFTCGGSRWRRSDILAHEAMGDTFPDADADEDSLAGELDEAMGSSEWLALTKSPQAFYRGRPSWQGTPGVLRGSRDVLAGLSSSCCKWGCSKSEISSLC

SEQ ID NO: 72548 - protein, 109 aa, Homo sapiens
  Payload ID: 14359
  Gene Symbol: RLN3
  Gene Name: relaxin 3
  ENSP ID: ENSP00000467130
MARYMLLLLLAVWVLTGELWPGAEARAAPYGVRLCGREFIRAVIFTCGGSRWRRSDILAHEAMEKNIEAPRSKFTCSRLEKLDSCSVSPAPKCTRSSINKERYLPGCRC

SEQ ID NO: 72549 - protein, 757 aa, Homo sapiens
  Payload ID: 14360
  Gene Symbol: RXFP1
  Gene Name: relaxin/insulin-like family peptide receptor 1
  Uniprot ID: Q9HBX9
  ENSP ID: ENSP00000303248
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 72550 - protein, 709 aa, Homo sapiens
  Payload ID: 14360
  Gene Symbol: RXFP1
  Gene Name: relaxin/insulin-like family peptide receptor 1
  Uniprot ID: Q9HBX9
  ENSP ID: ENSP00000345889
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDEFSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 72551 - protein, 784 aa, Homo sapiens
  Payload ID: 14360
  Gene Symbol: RXFP1
  Gene Name: relaxin/insulin-like family peptide receptor 1
  ENSP ID: ENSP00000405841
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECSFHFFLFITLLFLVPHCHHALPLPLDSVVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 72552 - protein, 601 aa, Homo sapiens
  Payload ID: 14360
  Gene Symbol: RXFP1
  Gene Name: relaxin/insulin-like family peptide receptor 1
  ENSP ID: ENSP00000414885
MVTCTQNMKAALKSLLYHSRNLGYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 72553 - protein, 724 aa, Homo sapiens
  Payload ID: 14360
  Gene Symbol: RXFP1
  Gene Name: relaxin/insulin-like family peptide receptor 1
  Uniprot ID: Q9HBX9
  ENSP ID: ENSP00000420712
MTSGSVFFYILIFGKYFSHGGGQDVKCSLGYFPCGNITKCLPQLLHCNGVDDCGNQADEDNCVVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 72554 - protein, 676 aa, Homo sapiens
  Payload ID: 14360
  Gene Symbol: RXFP1
  Gene Name: relaxin/insulin-like family peptide receptor 1
  ENSP ID: ENSP00000423306
MTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 72555 - protein, 157 aa, Homo sapiens
  Payload ID: 14360
  Gene Symbol: RXFP1
  Gene Name: relaxin/insulin-like family peptide receptor 1
  ENSP ID: ENSP00000432036
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLTL

SEQ ID NO: 72556 - protein, 189 aa, Homo sapiens
  Payload ID: 14360
  Gene Symbol: RXFP1
  Gene Name: relaxin/insulin-like family peptide receptor 1
  Uniprot ID: Q9HBX9
  ENSP ID: ENSP00000434475
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLSRAVKDGSEK

SEQ ID NO: 72557 - protein, 626 aa, Homo sapiens
  Payload ID: 14360
  Gene Symbol: RXFP1
  Gene Name: relaxin/insulin-like family peptide receptor 1
  ENSP ID: ENSP00000480522
MSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 72558 - protein, 754 aa, Homo sapiens
  Payload ID: 14361
  Gene Symbol: RXFP2
  Gene Name: relaxin/insulin-like family peptide receptor 2
  Uniprot ID: Q8WXD0
  ENSP ID: ENSP00000298386
MIVFLVFKHLFSLRLITMFFLLHFIVLINVKDFALTQGSMITPSCQKGYFPCGNLTKCLPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLFLPRNQIGFVPEKTFSSLKNLGELDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 72559 - protein, 730 aa, Homo sapiens
  Payload ID: 14361
  Gene Symbol: RXFP2
  Gene Name: relaxin/insulin-like family peptide receptor 2
  Uniprot ID: Q8WXD0
  ENSP ID: ENSP00000369670
MIVFLVFKHLFSLRLITMFFLLHFIVLINVKDFALTQGSMITPSCQKGYFPCGNLTKCLPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 72560 - protein, 469 aa, Homo sapiens
  Payload ID: 14362
  Gene Symbol: RXFP3
  Gene Name: relaxin/insulin-like family peptide receptor 3
  Uniprot ID: Q9NSD7
  ENSP ID: ENSP00000328708
MQMADAATIATMNKAAGGDKLAELFSLVPDLLEAANTSGNASLQLPDLWWELGLELPDGAPPGHPPGSGGAESADTEARVRILISVVYWVVCALGLAGNLLVLYLMKSMQGWRKSSINLFVTNLALTDFQFVLTLPFWAVENALDFKWPFGKAMCKIVSMVTSMNMYASVFFLTAMSVTRYHSVASALKSHRTRGHGRGDCCGRSLGDSCCFSAKALCVWIWALAALASLPSAIFSTTVKVMGEELCLVRFPDKLLGRDRQFWLGLYHSQKVLLGFVLPLGIIILCYLLLVRFIADRRAAGTKGGAAVAGGRPTGASARRLSKVTKSVTIVVLSFFLCWLPNQALTTWSILIKFNAVPFSQEYFLCQVYAFPVSVCLAHSNSCLNPVLYCLVRREFRKALKSLLWRIASPSITSMRPFTATTKPEHEDQGLQAPAPPHAAAEPDLLYYPPGVVVYSGGRYDLLPSSSAY

SEQ ID NO: 72561 - protein, 469 aa, Homo sapiens; identical to SEQ ID NO: 72560
  Payload ID: 14362
  Gene Symbol: RXFP3
  Gene Name: relaxin/insulin-like family peptide receptor 3
  Uniprot ID: Q9NSD7
  ENSP ID: ENSP00000480733

SEQ ID NO: 72562 - protein, 374 aa, Homo sapiens
  Payload ID: 14363
  Gene Symbol: RXFP4
  Gene Name: relaxin/insulin-like family peptide receptor 4
  Uniprot ID: Q8TDU9
  ENSP ID: ENSP00000357301
MPTLNTSASPPTFFWANASGGSVLSADDAPMPVKFLALRLMVALAYGLVGAIGLLGNLAVLWVLSNCARRAPGPPSDTFVFNLALADLGLALTLPFWAAESALDFHWPFGGALCKMVLTATVLNVYASIFLITALSVARYWVVAMAAGPGTHLSLFWARIATLAVWAAAALVTVPTAVFGVEGEVCGVRLCLLRFPSRYWLGAYQLQRVVLAFMVPLGVITTSYLLLLAFLQRRQRRRQDSRVVARSVRILVASFFLCWFPNHVVTLWGVLVKFDLVPWNSTFYTIQTYVFPVTTCLAHSNSCLNPVLYCLLRREPRQALAGTFRDLRLRLWPQGGGWVQQVALKQVGRRWVASNPRESRPSTLLTNLDRGTPG

SEQ ID NO: 72563 - protein, 430 aa, Homo sapiens
  Payload ID: 14364
  Gene Symbol: RELT
  Gene Name: RELT tumor necrosis factor receptor
  Uniprot ID: Q969Z4
  ENSP ID: ENSP00000064780
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 72564 - protein, 430 aa, Homo sapiens; identical to SEQ ID NO: 72563
  Payload ID: 14364
  Gene Symbol: RELT
  Gene Name: RELT tumor necrosis factor receptor
  Uniprot ID: Q969Z4
  ENSP ID: ENSP00000377207

SEQ ID NO: 72565 - protein, 101 aa, Homo sapiens
  Payload ID: 14364
  Gene Symbol: RELT
  Gene Name: RELT tumor necrosis factor receptor
  ENSP ID: ENSP00000439352
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPW

SEQ ID NO: 72566 - protein, 103 aa, Homo sapiens
  Payload ID: 14364
  Gene Symbol: RELT
  Gene Name: RELT tumor necrosis factor receptor
  ENSP ID: ENSP00000440562
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGNQPCLPD

SEQ ID NO: 72567 - protein, 271 aa, Homo sapiens
  Payload ID: 14365
  Gene Symbol: RELL1
  Gene Name: RELT-like 1
  Uniprot ID: Q8IUW5
  ENSP ID: ENSP00000313385
MAPRALPGSAVLAAAVFVGGAVSSPLVAPDNGSSRTLHSRTETTPSPSNDTGNGHPEYIAYALVPVFFIMGLFGVLICHLLKKKGYRCTTEAEQDIEEEKVEKIELNDSVNENSDTVGQIVHYIMKNEANADVLKAMVADNSLYDPESPVTPSTPGSPPVSPGPLSPGGTPGKHVCGHHLHTVGGVVERDVCHRCRHKRWHFIKPTNKSRESRPRRQGEVTVLSVGRFRVTKVEHKSNQKERRSLMSVSGAETVNGEVPATPVKRERSGTE

SEQ ID NO: 72568 - protein, 271 aa, Homo sapiens; identical to SEQ ID NO: 72567
  Payload ID: 14365
  Gene Symbol: RELL1
  Gene Name: RELT-like 1
  Uniprot ID: Q8IUW5
  ENSP ID: ENSP00000398778

SEQ ID NO: 72569 - protein, 247 aa, Homo sapiens
  Payload ID: 14365
  Gene Symbol: RELL1
  Gene Name: RELT-like 1
  ENSP ID: ENSP00000424031
MNPGACWYIYILQKGLTQQGGEAVGCISCPALKRIYLFMFVKTVGIWQMGYNGSSRTLHSRTETTPSPSNDTGNGHPEYIAYALVPVFFIMGLFGVLICHLLKKKGYRCTTEAEQDIEEEKVEKIELNDSVNENSDTVGQIVHYIMKNEANADVLKAMVADNSLYDPESPVTPSTPGSPPVSPGPLSPGGTPGKHVCGHHLHTVGGVVERDVCHRCRHKRWHFIKPTNKSRESRPRRQGEVTVLSVG

SEQ ID NO: 72570 - protein, 303 aa, Homo sapiens
  Payload ID: 14366
  Gene Symbol: RELL2
  Gene Name: RELT-like 2
  Uniprot ID: Q8NC24
  ENSP ID: ENSP00000297164
MSEPQPDLEPPQHGLYMLFLLVLVFFLMGLVGFMICHVLKKKGYRCRTSRGSEPDDAQLQPPEDDDMNEDTVERIVRCIIQNEANAEALKEMLGDSEGEGTVQLSSVDATSSLQDGAPSHHHTVHLGSAAPCLHCSRSKRPPLVRQGRSKEGKSRPRTGETTVFSVGRFRVTHIEKRYGLHEHRDGSPTDRSWGSGGGQDPGGGQGSGGGQPKAGMPAMERLPPERPQPQVLASPPVQNGGLRDSSLTPRALEGNPRASAEPTLRAGGRGPSPGLPTQEANGQPSKPDTSDHQVSLPQGAGSM

SEQ ID NO: 72571 - protein, 303 aa, Homo sapiens; identical to SEQ ID NO: 72570
  Payload ID: 14366
  Gene Symbol: RELL2
  Gene Name: RELT-like 2
  Uniprot ID: Q8NC24
  ENSP ID: ENSP00000409443

SEQ ID NO: 72572 - protein, 237 aa, Homo sapiens
  Payload ID: 14366
  Gene Symbol: RELL2
  Gene Name: RELT-like 2
  ENSP ID: ENSP00000427992
MNEDTVERIVRCIIQNEANAEALKEMLGDSEGEGTVQLSSVDATSSLQDGAPSHHHTVHLGSAAPCLHCSRSKRPPLVRQGRSKEGKSRPRTGETTVFSVGRFRVTHIEKRYGLHEHRDGSPTDRSWGSGGGQDPGGGQGSGGGQPKAGMPAMERLPPERPQPQVLASPPVQNGGLRDSSLTPRALEGNPRASAEPTLRAGGRGPSPGLPTQEANGQPSKPDTSDHQVSLPQGAGSM

SEQ ID NO: 72573 - protein, 232 aa, Homo sapiens
  Payload ID: 14366
  Gene Symbol: RELL2
  Gene Name: RELT-like 2
  ENSP ID: ENSP00000430948
MNEDTVERIVRCIIQNEANAEALKEMLGDSEGEGTVQLSSVDATSSLQDGAPSHHHTVHLGSAAPCLHCSRSKRPPLVRQGRSKEGKSRPRTGETTVFSVGRFRVTHIEKRYGLHEHRDGSPTDRSWGSGGGQDPGGGQGSGGGQPKAGMPAMERLPPERPQPQVLASPPVQNGGLRDSSLTPRALEGNPRASAEPTLRAGGRGPSPGLPTQEANGQPSKPDTSDHQSPSLC

SEQ ID NO: 72574 - protein, 258 aa, Homo sapiens
  Payload ID: 14367
  Gene Symbol: RSG1
  Gene Name: REM2 and RAB-like small GTPase 1
  Uniprot ID: Q9BU20
  ENSP ID: ENSP00000364749
MARPPVPGSVVVPNWHESAEGKEYLACILRKNRRRVFGLLERPVLLPPVSIDTASYKIFVSGKSGVGKTALVAKLAGLEVPVVHHETTGIQTTVVFWPAKLQASSRVVMFRFEFWDCGESALKKFDHMLLACMENTDAFLFLFSFTDRASFEDLPGQLARIAGEAPGVVRMVIGSKFDQYMHTDVPERDLTAFRQAWELPLLRVKSVPGRRLADGRTLDGRAGLADVAHILNGLAEQLWHQDQVAAGLLPNPPESAPE

SEQ ID NO: 72575 - protein, 112 aa, Homo sapiens
  Payload ID: 14367
  Gene Symbol: RSG1
  Gene Name: REM2 and RAB-like small GTPase 1
  ENSP ID: ENSP00000406390
  MOD_RES (1)..(1): Any amino acid
XCARTAGGCLGCLSGQCCCRLCPLTLPATRSLCPGRVVWARRRWWPSWLAWRCLWCTTRPPACMENTDAFLFLFSFTDRASFEDLPGQLARIAGEAPGVVRMVIGSKFDQYM

SEQ ID NO: 72576 - protein, 1441 aa, Homo sapiens
  Payload ID: 14368
  Gene Symbol: RSF1
  Gene Name: remodeling and spacing factor 1
  Uniprot ID: Q96T23
  ENSP ID: ENSP00000311513
MATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 72577 - protein, 202 aa, Homo sapiens
  Payload ID: 14368
  Gene Symbol: RSF1
  Gene Name: remodeling and spacing factor 1
  ENSP ID: ENSP00000408844
  MOD_RES (1)..(1): Any amino acid
XAAAAAAVMAPPGCPGSCPNFAVVCSFLERYGPLLDLPELPFPELERVLQAPPPDVGNGEVPKELVELHLKLMRKIGKSVTADRWEKYLIKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEET

SEQ ID NO: 72578 - protein, 803 aa, Homo sapiens
  Payload ID: 14368
  Gene Symbol: RSF1
  Gene Name: remodeling and spacing factor 1
  ENSP ID: ENSP00000432022
ETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKK

SEQ ID NO: 72579 - protein, 276 aa, Homo sapiens
  Payload ID: 14368
  Gene Symbol: RSF1
  Gene Name: remodeling and spacing factor 1
  ENSP ID: ENSP00000433603
EPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTP

SEQ ID NO: 72580 - protein, 1189 aa, Homo sapiens
  Payload ID: 14368
  Gene Symbol: RSF1
  Gene Name: remodeling and spacing factor 1
  Uniprot ID: Q96T23
  ENSP ID: ENSP00000434509
MKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 72581 - protein, 702 aa, Homo sapiens
  Payload ID: 14368
  Gene Symbol: RSF1
  Gene Name: remodeling and spacing factor 1
  ENSP ID: ENSP00000436408
ATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQK

SEQ ID NO: 72582 - protein, 165 aa, Homo sapiens
  Payload ID: 14368
  Gene Symbol: RSF1
  Gene Name: remodeling and spacing factor 1
  ENSP ID: ENSP00000436728
  MOD_RES (1)..(1): Any amino acid
XKPDSPPKVLEPENKQEKTEKEEEKTNVGRTLRRSPRISRPTAKVAEIRDQKADKKRGEGEDEVEEESTALQKTDKKEILKKSEKDTNSKVKPKGKVRWTGSRTRGRWKYSSNDESEGSGSEKSSAASEEEEEKESEEAILADDDEPCKKCGLPNHPELILLCDS

SEQ ID NO: 72583 - protein, 342 aa, Homo sapiens
  Payload ID: 14369
  Gene Symbol: RNLS
  Gene Name: renalase, FAD-dependent amine oxidase
  Uniprot ID: Q5VYX0
  ENSP ID: ENSP00000332530
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 72584 - protein, 315 aa, Homo sapiens
  Payload ID: 14369
  Gene Symbol: RNLS
  Gene Name: renalase, FAD-dependent amine oxidase
  Uniprot ID: Q5VYX0
  ENSP ID: ENSP00000361015
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITTLISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVPSAGVILGCAKSPWMMAIGFPI

SEQ ID NO: 72585 - protein, 175 aa, Homo sapiens
  Payload ID: 14369
  Gene Symbol: RNLS
  Gene Name: renalase, FAD-dependent amine oxidase
  ENSP ID: ENSP00000387577
MAQVLIVGAGMTGSLCAALLRRQTSGPLYLAVWDKAEDSGGRMTTACSPHNPQCTADLGAQYITCTPHYAKKHQRFYDELLAYGVLRPLSSPIEGMVMKEGDCNFVAPQGISSIIKHYLKESGAEVYFRHRVTQINLRDDKWEVSKQTGSPEQFDLIVLTMPVPEILQLQGDITT

SEQ ID NO: 72586 - protein, 406 aa, Homo sapiens
  Payload ID: 14370
  Gene Symbol: REN
  Gene Name: renin
  Uniprot ID: P00797
  ENSP ID: ENSP00000272190
MDGWRRMPRWGLLLLLWGSCTFGLPTDTTTFKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 72587 - protein, 413 aa, Homo sapiens
  Payload ID: 14371
  Gene Symbol: RENBP
  Gene Name: renin binding protein
  ENSP ID: ENSP00000359014
MSKGLPARQDMEKERETLQAWKERVGQELDRVVAFWMEHSHDQEHGGFFTCLGREGRVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQFRDPEYGEWFGYLSREGKVALSIKGGPFKGCFHVPRCLAMCEEMLGALLSRPAPAPSPAPTPACRGAE

SEQ ID NO: 72588 - protein, 427 aa, Homo sapiens
  Payload ID: 14371
  Gene Symbol: RENBP
  Gene Name: renin binding protein
  Uniprot ID: P51606
  ENSP ID: ENSP00000377303
MSKGLPARQDMEKERETLQAWKERVGQELDRVVAFWMEHSHDQEHGGFFTCLGREGRVYDDLKYVWLQGRQVWMYCRLYRTFERFRHAQLLDAAKAGGEFLLRYARVAPPGKKCAFVLTRDGRPVKVQRTIFSECFYTMAMNELWRATGEVRYQTEAVEMMDQIVHWVQEDASGLGRPQLQGAPAAEPMAVPMMLLNLVEQLGEADEELAGKYAELGDWCARRILQHVQRDGQAVLENVSEGGKELPGCLGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQFRDPEYGEWFGYLSREGKVALSIKGGPFKGCFHVPRCLAMCEEMLGALLSRPAPAPSPAPTPACRGAE

SEQ ID NO: 72589 - protein, 60 aa, Homo sapiens
  Payload ID: 14371
  Gene Symbol: RENBP
  Gene Name: renin binding protein
  ENSP ID: ENSP00000394220
MSKGLPARQARHGERARDSAGLEGARGAGAGPRGGFLDGALPRPGARGLLHVPWPRGAGV

SEQ ID NO: 72590 - protein, 159 aa, Homo sapiens
  Payload ID: 14371
  Gene Symbol: RENBP
  Gene Name: renin binding protein
  ENSP ID: ENSP00000399278
TFERFRHAQLLDAAKAGGEFLLRYARVAPPGKKCAFVLTRDGRPVKVQRTIFSECFYTMAMNELWRATGEVRYQEDASGLGRPQLQGAPAAEPMAVPMMLLNLVEQLGEADEELAGKYAELGDWCARRILQHVQATRWKPAGFCSVIAFGKATPNFEPT

SEQ ID NO: 72591 - protein, 116 aa, Homo sapiens
  Payload ID: 14371
  Gene Symbol: RENBP
  Gene Name: renin binding protein
  ENSP ID: ENSP00000405759
  MOD_RES (1)..(1): Any amino acid
XGRQQNPGHTLEAGWFLLRHCIRKGDPELRAHVIDKFLLLPFHSGWDPDHGGLFYFQDADNFCPTQLEWAMKLWWPHSEAMIAFLMGYSDSGDPVLLRLFYQVAEYTFRQGLYRPG

SEQ ID NO: 72592 - protein, 125 aa, Homo sapiens
  Payload ID: 14371
  Gene Symbol: RENBP
  Gene Name: renin binding protein
  ENSP ID: ENSP00000409034
LWWPHSEAMIAFLMGYSDSGDPVLLRLFYQVAEYTFRQAGAQWRDLSSLQPPPPVFKLFSRLSLPSILLGLQFRDPEYGEWFGYLSREGKVALSIKGGPFKGCFHVPRCLAMCEEMLGALLSRPA

SEQ ID NO: 72593 - protein, 784 aa, Homo sapiens
  Payload ID: 14372
  Gene Symbol: RPTN
  Gene Name: repetin
  Uniprot ID: Q6XPR3
  ENSP ID: ENSP00000317895
MAQLLNSILSVIDVFHKYAKGNGDCALLCKEELKQLLLAEFGDILQRPNDPETVETILNLLDQDRDGHIDFHEYLLLVFQLVQACYHKLDNKSHGGRTSQQERGQEGAQDCKFPGNTGRQHRQRHEEERQNSHHSQPERQDGDSHHGQPERQDRDSHHGQSEKQDRDSHHSQPERQDRDSHHNQSERQDKDFSFDQSERQSQDSSSGKKVSHKSTSGQAKWQGHIFALNRCEKPIQDSHYGQSERHTQQSETLGQASHFNQTNQQKSGSYCGQSERLGQELGCGQTDRQGQSSHYGQTDRQDQSYHYGQTDRQGQSSHYSQTDRQGQSSHYSQPDRQGQSSHYGQMDRKGQCYHYDQTNRQGQGSHYSQPNRQGQSSHYGQPDTQDQSSHYGQTDRQDQSSHYGQTERQGQSSHYSQMDRQGQGSHYGQTDRQGQSSHYGQPDRQGQNSHYGQTDRQGQSSHYGQTDRQGQSSHYSQPDKQGQSSHYGKIDRQDQSYHYGQPDGQGQSSHYGQTDRQGQSFHYGQPDRQGQSSHYSQMDRQGQSSHYGQTDRQGQSSHYGQTDRQGQSYHYGQTDRQGQSSHYIQSQTGEIQGQNKYFQGTEGTRKASYVEQSGRSGRLSQQTPGQEGYQNQGQGFQSRDSQQNGHQVWEPEEDSQHHQHKLLAQIQQERPLCHKGRDWQSCSSEQGHRQAQTRQSHGEGLSHWAEEEQGHQTWDRHSHESQEGPCGTQDRRTHKDEQNHQRRDRQTHEHEQSHQRRDRQTHEDKQNRQRRDRQTHEDEQNHQR

SEQ ID NO: 72594 - protein, 1147 aa, Homo sapiens
  Payload ID: 14373
  Gene Symbol: RFC1
  Gene Name: replication factor C (activator 1) 1, 145kDa
  Uniprot ID: P35251
  ENSP ID: ENSP00000261424
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 72595 - protein, 1148 aa, Homo sapiens
  Payload ID: 14373
  Gene Symbol: RFC1
  Gene Name: replication factor C (activator 1) 1, 145kDa
  Uniprot ID: P35251
  ENSP ID: ENSP00000371321
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 72596 - protein, 187 aa, Homo sapiens
  Payload ID: 14373
  Gene Symbol: RFC1
  Gene Name: replication factor C (activator 1) 1, 145kDa
  ENSP ID: ENSP00000422129
PEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEELGYSYVELNASDTRSKSSLKAIVAESLNNTSIKGFYSNGAASSVSTKHALIMDEVDGM

SEQ ID NO: 72597 - protein, 130 aa, Homo sapiens
  Payload ID: 14373
  Gene Symbol: RFC1
  Gene Name: replication factor C (activator 1) 1, 145kDa
  ENSP ID: ENSP00000422475
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETEETITGIIRDAVRERARPSA

SEQ ID NO: 72598 - protein, 132 aa, Homo sapiens
  Payload ID: 14373
  Gene Symbol: RFC1
  Gene Name: replication factor C (activator 1) 1, 145kDa
  ENSP ID: ENSP00000422740
MDIRKFFGVIPSGKKLVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKL

SEQ ID NO: 72599 - protein, 101 aa, Homo sapiens
  Payload ID: 14373
  Gene Symbol: RFC1
  Gene Name: replication factor C (activator 1) 1, 145kDa
  ENSP ID: ENSP00000424713
  MOD_RES (1)..(1): Any amino acid
XMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKVVF

SEQ ID NO: 72600 - protein, 354 aa, Homo sapiens
  Payload ID: 14374
  Gene Symbol: RFC2
  Gene Name: replication factor C (activator 1) 2, 40kDa
  Uniprot ID: P35250
  ENSP ID: ENSP00000055077
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 72601 - protein, 320 aa, Homo sapiens
  Payload ID: 14374
  Gene Symbol: RFC2
  Gene Name: replication factor C (activator 1) 2, 40kDa
  Uniprot ID: P35250
  ENSP ID: ENSP00000275627
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 72602 - protein, 77 aa, Homo sapiens
  Payload ID: 14374
  Gene Symbol: RFC2
  Gene Name: replication factor C (activator 1) 2, 40kDa
  ENSP ID: ENSP00000418899
MEVEAVCGGAGEVEAQDSDPAPAFSKAPGSAGHYELPWVEKYRPVKLNEIVGNEDTVSRLEVFAREGNVPNIIIAGH

SEQ ID NO: 72603 - protein, 120 aa, Homo sapiens
  Payload ID: 14374
  Gene Symbol: RFC2
  Gene Name: replication factor C (activator 1) 2, 40kDa
  ENSP ID: ENSP00000419320
  MOD_RES (1)..(1): Any amino acid
XERVPYTDDGLEAIIFTAQGDMRQALNNLQSTFSGFGFINSENVFKVCDEPHPLLVKEMIQHCVNANIDEAYKVGLLPPVLAEEPLTSWAEESGSPSDSCSLVASGLLTRRYHWQHLSSV

SEQ ID NO: 72604 - protein, 87 aa, Homo sapiens
  Payload ID: 14374
  Gene Symbol: RFC2
  Gene Name: replication factor C (activator 1) 2, 40kDa
  ENSP ID: ENSP00000419341
  MOD_RES (1)..(1): Any amino acid
XCGGAGEVEAQDSDPAPAFSKAPGSAGHYELPWVEKYRPVKLNEIVGNEDTVSRLEVFAREGNVPNIIIAHDRRSPASLEENHGNLL

SEQ ID NO: 72605 - protein, 101 aa, Homo sapiens
  Payload ID: 14374
  Gene Symbol: RFC2
  Gene Name: replication factor C (activator 1) 2, 40kDa
  ENSP ID: ENSP00000419827
ARMEVEAVCGGAGEVEAQDSDPAPAFSKAPGSAGHYELPWVEKYRPVKLNEIVGNEDTVSRLEVFAREGNVPNIIIAGSEVTEMQTAVNITQELPEVLLVV

SEQ ID NO: 72606 - protein, 52 aa, Homo sapiens
  Payload ID: 14374
  Gene Symbol: RFC2
  Gene Name: replication factor C (activator 1) 2, 40kDa
  ENSP ID: ENSP00000420392
  MOD_RES (1)..(1): Any amino acid
XDSDPAPAFSKAPGSAGHYELPWVEKYRPVKLNEIVGNEDTVSRLESSRSKF

SEQ ID NO: 72607 - protein, 198 aa, Homo sapiens
  Payload ID: 14374
  Gene Symbol: RFC2
  Gene Name: replication factor C (activator 1) 2, 40kDa
  ENSP ID: ENSP00000420404
  MOD_RES (1)..(1): Any amino acid
XMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKELPNGFPKWLQHVHSHQHSGGSST

SEQ ID NO: 72608 - protein, 75 aa, Homo sapiens
  Payload ID: 14374
  Gene Symbol: RFC2
  Gene Name: replication factor C (activator 1) 2, 40kDa
  ENSP ID: ENSP00000420513
  MOD_RES (1)..(1): Any amino acid
XKAPGSAGHYELPWVEKYRPVKLNEIVGNEDTVSRLEVFAREGNVPNIIIAGSEVTEMQTAVNITQELPEVLLVV

SEQ ID NO: 72609 - protein, 37 aa, Homo sapiens
  Payload ID: 14374
  Gene Symbol: RFC2
  Gene Name: replication factor C (activator 1) 2, 40kDa
  ENSP ID: ENSP00000420563
MEVEAVCGGAGEVEAQDSDPAPAFSKAPGSAGHYELP

SEQ ID NO: 72610 - protein, 28 aa, Homo sapiens
  Payload ID: 14374
  Gene Symbol: RFC2
  Gene Name: replication factor C (activator 1) 2, 40kDa
  ENSP ID: ENSP00000420731
EKYRPVKLNEIVGNEDTVSRLESSRSKF

SEQ ID NO: 72611 - protein, 251 aa, Homo sapiens
  Payload ID: 14374
  Gene Symbol: RFC2
  Gene Name: replication factor C (activator 1) 2, 40kDa
  ENSP ID: ENSP00000479768
MCPTSSLRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 72612 - protein, 356 aa, Homo sapiens
  Payload ID: 14375
  Gene Symbol: RFC3
  Gene Name: replication factor C (activator 1) 3, 38kDa
  Uniprot ID: P40938
  ENSP ID: ENSP00000369411
MSLWVDKYRPCSLGRLDYHKEQAAQLRNLVQCGDFPHLLVYGPSGAGKKTRIMCILRELYGVGVEKLRIEHQTITTPSKKKIEISTIASNYHLEVNPSDAGNSDRVVIQEMLKTVAQSQQLETNSQRDFKVVLLTEVDKLTKDAQHALRRTMEKYMSTCRLILCCNSTSKVIPPIRSRCLAVRVPAPSIEDICHVLSTVCKKEGLNLPSQLAHRLAEKSCRNLRKALLMCEACRVQQYPFTADQEIPETDWEVYLRETANAIVSQQTPQRLLEVRGRLYELLTHCIPPEIIMKGLLSELLHNCDGQLKGEVAQMAAYYEHRLQLGSKAIYHLEAFVAKFMALYKKFMEDGLEGMMF

SEQ ID NO: 72613 - protein, 305 aa, Homo sapiens
  Payload ID: 14375
  Gene Symbol: RFC3
  Gene Name: replication factor C (activator 1) 3, 38kDa
  Uniprot ID: P40938
  ENSP ID: ENSP00000401001
MSLWVDKYRPCSLGRLDYHKEQAAQLRNLVQCGDFPHLLVYGPSGAGKKTRIMCILRELYGVGVEKLRIEHQTITTPSKKKIEISTIASNYHLEVNPSDAGNSDRVVIQEMLKTVAQSQQLETNSQRDFKVVLLTEVDKLTKDAQHALRRTMEKYMSTCRLILCCNSTSKVIPPIRSRCLAVRVPAPSIEDICHVLSTVCKKEGLNLPSQLAHRLAEKSCRNLRKALLMCEACRVQQYPFTADQEIPETDWEVYLRETANAIVSQQTPQRLLEVRGRLYELLTHCIPPEIIMKACKEESRSCDIF

SEQ ID NO: 72614 - protein, 103 aa, Homo sapiens
  Payload ID: 14375
  Gene Symbol: RFC3
  Gene Name: replication factor C (activator 1) 3, 38kDa
  ENSP ID: ENSP00000484747
EGLNLPSQLAHRLAEKSCRNLRKALLMCEACRVQQYPFTADQEIPETDWEVYLRETANAIVSQQTPQRLLEVRGRLYELLTHCIPPEIIMKACKEESRSCDIF

SEQ ID NO: 72615 - protein, 363 aa, Homo sapiens
  Payload ID: 14376
  Gene Symbol: RFC4
  Gene Name: replication factor C (activator 1) 4, 37kDa
  Uniprot ID: P35249
  ENSP ID: ENSP00000296273
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDIAKKENVKISDEGIAYLVKVSEGDLRKAITFLQSATRLTGGKEITEKVITDIAGVIPAEKIDGVFAACQSGSFDKLEAVVKDLIDEGHAATQLVNQLHDVVVENNLSDKQKSIITEKLAEVDKCLADGADEHLQLISLCATVMQQLSQNC

SEQ ID NO: 72616 - protein, 363 aa, Homo sapiens; identical to SEQ ID NO: 72615
  Payload ID: 14376
  Gene Symbol: RFC4
  Gene Name: replication factor C (activator 1) 4, 37kDa
  Uniprot ID: P35249
  ENSP ID: ENSP00000376272

SEQ ID NO: 72617 - protein, 97 aa, Homo sapiens
  Payload ID: 14376
  Gene Symbol: RFC4
  Gene Name: replication factor C (activator 1) 4, 37kDa
  ENSP ID: ENSP00000394870
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFG

SEQ ID NO: 72618 - protein, 43 aa, Homo sapiens
  Payload ID: 14376
  Gene Symbol: RFC4
  Gene Name: replication factor C (activator 1) 4, 37kDa
  ENSP ID: ENSP00000399314
MQAFLKGTSISTKPPLTKDRGVAASAGSSGENKKAKPVPWVEK

SEQ ID NO: 72619 - protein, 336 aa, Homo sapiens
  Payload ID: 14376
  Gene Symbol: RFC4
  Gene Name: replication factor C (activator 1) 4, 37kDa
  ENSP ID: ENSP00000399769
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDIAKKENVKISDEGIAYLVKVSEGDLRKAITFLQSATRLTGGKEITEKVITDIAGDLIDEGHAATQLVNQLHDVVVENNLSDKQKSIITEKLAEVDKCLADGADEHLQLISLCATVMQQLSQNC

SEQ ID NO: 72620 - protein, 111 aa, Homo sapiens
  Payload ID: 14376
  Gene Symbol: RFC4
  Gene Name: replication factor C (activator 1) 4, 37kDa
  ENSP ID: ENSP00000401429
GIAYLVKVSEGDLRKAITFLQSATRLTGGKEITEKVITDIAGVIPAEKIDGVFAACQSGSFDKLEAVVKDLIDEGHAATQLVNQLHDVVVENNLSDKQKSIITEKLALTNA

SEQ ID NO: 72621 - protein, 123 aa, Homo sapiens
  Payload ID: 14376
  Gene Symbol: RFC4
  Gene Name: replication factor C (activator 1) 4, 37kDa
  ENSP ID: ENSP00000407982
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKV

SEQ ID NO: 72622 - protein, 214 aa, Homo sapiens
  Payload ID: 14376
  Gene Symbol: RFC4
  Gene Name: replication factor C (activator 1) 4, 37kDa
  ENSP ID: ENSP00000411300
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDI

SEQ ID NO: 72623 - protein, 167 aa, Homo sapiens
  Payload ID: 14376
  Gene Symbol: RFC4
  Gene Name: replication factor C (activator 1) 4, 37kDa
  ENSP ID: ENSP00000413065
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTM

SEQ ID NO: 72624 - protein, 95 aa, Homo sapiens
  Payload ID: 14376
  Gene Symbol: RFC4
  Gene Name: replication factor C (activator 1) 4, 37kDa
  ENSP ID: ENSP00000415099
MQAFLKGTSISTKPPLTKDRGVAASAGSSGENKKAKPVPWVEKYRPKCVDEVAFQEEVVAVLKKSLEGADLPNLLFYGPPGTGKTSTILAAAREL

SEQ ID NO: 72625 - protein, 319 aa, Homo sapiens
  Payload ID: 14377
  Gene Symbol: RFC5
  Gene Name: replication factor C (activator 1) 5, 36.5kDa
  Uniprot ID: P40937
  ENSP ID: ENSP00000376325
MVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 72626 - protein, 104 aa, Homo sapiens
  Payload ID: 14377
  Gene Symbol: RFC5
  Gene Name: replication factor C (activator 1) 5, 36.5kDa
  ENSP ID: ENSP00000390340
MVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILD

SEQ ID NO: 72627 - protein, 99 aa, Homo sapiens
  Payload ID: 14377
  Gene Symbol: RFC5
  Gene Name: replication factor C (activator 1) 5, 36.5kDa
  ENSP ID: ENSP00000393636
MVLELNASDDRGIDIIRGPILSFASTRTIFKKGFKLVILDEADAMTQDAQNALRRVIEKFTENTRFCLICNYLSKIIPALQSRCTRFRFGPLTPELMVP

SEQ ID NO: 72628 - protein, 340 aa, Homo sapiens
  Payload ID: 14377
  Gene Symbol: RFC5
  Gene Name: replication factor C (activator 1) 5, 36.5kDa
  Uniprot ID: P40937
  ENSP ID: ENSP00000408295
METSALKQQEQPAATKIRNLPWVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 72629 - protein, 63 aa, Homo sapiens
  Payload ID: 14377
  Gene Symbol: RFC5
  Gene Name: replication factor C (activator 1) 5, 36.5kDa
  ENSP ID: ENSP00000438252
MVEKYRPQTLNDLISHQDILSTIQKFINEDRLPHLLLYGPPGTGKTSTILACAKQLYKDKEFG

SEQ ID NO: 72630 - protein, 104 aa, Homo sapiens
  Payload ID: 14377
  Gene Symbol: RFC5
  Gene Name: replication factor C (activator 1) 5, 36.5kDa
  ENSP ID: ENSP00000443187
MVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHV

SEQ ID NO: 72631 - protein, 139 aa, Homo sapiens
  Payload ID: 14377
  Gene Symbol: RFC5
  Gene Name: replication factor C (activator 1) 5, 36.5kDa
  ENSP ID: ENSP00000445917
MLERSGVITAQCNLKHWGSSHSPASASEELGLLEPLATTNLLSIYGFAYSGHFMVEKYRPQTLNDLISHQDILSTIQKFINEDRLPHLLLYGPPGTGKTSTILACAKQLYKDKEFGSMVLELNASDDRGIDIIRGPILS

SEQ ID NO: 72632 - protein, 567 aa, Homo sapiens
  Payload ID: 14378
  Gene Symbol: REPIN1
  Gene Name: replication initiator 1
  Uniprot ID: Q9BWE0
  ENSP ID: ENSP00000380451
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 72633 - protein, 567 aa, Homo sapiens; identical to SEQ ID NO: 72632
  Payload ID: 14378
  Gene Symbol: REPIN1
  Gene Name: replication initiator 1
  Uniprot ID: Q9BWE0
  ENSP ID: ENSP00000388287

SEQ ID NO: 72634 - protein, 567 aa, Homo sapiens; identical to SEQ ID NO: 72632
  Payload ID: 14378
  Gene Symbol: REPIN1
  Gene Name: replication initiator 1
  Uniprot ID: Q9BWE0
  ENSP ID: ENSP00000407714

SEQ ID NO: 72635 - protein, 624 aa, Homo sapiens
  Payload ID: 14378
  Gene Symbol: REPIN1
  Gene Name: replication initiator 1
  Uniprot ID: Q9BWE0
  ENSP ID: ENSP00000417291
MGIGVSLLLQFSLTPGGYRSVGRSRRCSRGSIPRNIPKRSWKKPHPQLCSLQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLPAGPQESAAEPTPAVPLKPAQEPPPGAPPEHPQDPIEAPPSLYSCDDCGRSFRLERFLRAHQRQHTGERPFTCAECGKNFGKKTHLVAHSRVHSGERPFACEECGRRFSQGSHLAAHRRDHAPDRPFVCPDCGKAFRHKPYLAAHRRIHTGEKPYVCPDCGKAFSQKSNLVSHRRIHTGERPYACPDCDRSFSQKSNLITHRKSHIRDGAFCCAICGQTFDDEERLLAHQKKHDV

SEQ ID NO: 72636 - protein, 87 aa, Homo sapiens
  Payload ID: 14378
  Gene Symbol: REPIN1
  Gene Name: replication initiator 1
  ENSP ID: ENSP00000417786
MGIGVSLLLQFSLTPGGYRSVGRSRRCSRGSIPRNIPKRSWKKPHPQLCSLQGLVIFDVSQLLHLLNRELSVCLSSFSELLCSSDVA

SEQ ID NO: 72637 - protein, 136 aa, Homo sapiens
  Payload ID: 14378
  Gene Symbol: REPIN1
  Gene Name: replication initiator 1
  ENSP ID: ENSP00000417982
MGIGVSLLLQFSLTPGGYRSVGRSRRCSRGSIPRNIPKRSWKKPHPQLCSLQGSSVSVCPASQSCCAARMWHRKQQTQGEGSIRHCREQWPHFLQRKNRCWNVVAGAPWPWAWPSPDSFLGPPRSHPRPWGRSPAG

SEQ ID NO: 72638 - protein, 47 aa, Homo sapiens
  Payload ID: 14378
  Gene Symbol: REPIN1
  Gene Name: replication initiator 1
  ENSP ID: ENSP00000418279
MDGRRVPAQPAAEVRPGQGRGATAGPRGAAPPAGRVTVRLASLQSEV

SEQ ID NO: 72639 - protein, 55 aa, Homo sapiens
  Payload ID: 14378
  Gene Symbol: REPIN1
  Gene Name: replication initiator 1
  ENSP ID: ENSP00000418507
MDGRRVPAQPAAEQRKNRCWNVVAGAPWPWAWPSPDSFLGPPRSHPRPWGRSPAG

SEQ ID NO: 72640 - protein, 366 aa, Homo sapiens
  Payload ID: 14378
  Gene Symbol: REPIN1
  Gene Name: replication initiator 1
  ENSP ID: ENSP00000419789
MDGRRVPAQPAAEFSLTPGGYRSVGRSRRCSRGSIPRNIPKRSWKKPHPQLCSLQEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNL

SEQ ID NO: 72641 - protein, 393 aa, Homo sapiens
  Payload ID: 14378
  Gene Symbol: REPIN1
  Gene Name: replication initiator 1
  ENSP ID: ENSP00000419872
MDGRRVPAQPAAEFSLTPGGYRSVGRSRRCSRGSIPRNIPKRSWKKPHPQLCSLQAEEEPMLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIACPKCERRFWRRKQLRAHLRRCHPPAPEARPFICGNCGRSFAQWDQLVAHKRVHVAEALEEAAAKALGPRPRGRPAVTAPRPGGDAVDRPFQCACCGKRFRHKPNLIAHRRVHTGERPHQCPECGKRFTNKPYLTSHRRIHTGEKPYPCKECGRRFRHKPNLLSHSKIHKRSEGSAQAAPGPGSPQLP

SEQ ID NO: 72642 - protein, 136 aa, Homo sapiens; identical to SEQ ID NO: 72637
  Payload ID: 14378
  Gene Symbol: REPIN1
  Gene Name: replication initiator 1
  ENSP ID: ENSP00000420578

SEQ ID NO: 72643 - protein, 47 aa, Homo sapiens; identical to SEQ ID NO: 72638
  Payload ID: 14378
  Gene Symbol: REPIN1
  Gene Name: replication initiator 1
  ENSP ID: ENSP00000427721

SEQ ID NO: 72644 - protein, 136 aa, Homo sapiens
  Payload ID: 14378
  Gene Symbol: REPIN1
  Gene Name: replication initiator 1
  ENSP ID: ENSP00000428129
MDGRRVPAQPAAEVRPGQGRGATAGPRGAAPPAGRVTVSVRDRVRGRTDAGTSLQGPPGHGPGPAPTPFWALPGVTPDPGEGVPRAEATRHVSGPVWCPSPRQGPSLCPLSKALPWLGGSVASHPPVPGPAALALP

SEQ ID NO: 72645 - protein, 146 aa, Homo sapiens
  Payload ID: 14378
  Gene Symbol: REPIN1
  Gene Name: replication initiator 1
  ENSP ID: ENSP00000428562
MLERRCRGPLAMGLAQPRLLSGPSQESPQTLGKESRGLRQQGTSVAQSGAQAPGRAHRCAHCRRHFPGWVALWLHTRRCQARLPLPCPECGRRFRHAPFLALHRQVHAAATPDLGFACHLCGQSFRGWVALVLHLRAHSAAKRPIA

SEQ ID NO: 72646 - protein, 616 aa, Homo sapiens
  Payload ID: 14379
  Gene Symbol: RPA1
  Gene Name: replication protein A1, 70kDa
  Uniprot ID: P27694
  ENSP ID: ENSP00000254719
MVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 72647 - protein, 153 aa, Homo sapiens
  Payload ID: 14379
  Gene Symbol: RPA1
  Gene Name: replication protein A1, 70kDa
  ENSP ID: ENSP00000459788
MQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFG

SEQ ID NO: 72648 - protein, 313 aa, Homo sapiens
  Payload ID: 14379
  Gene Symbol: RPA1
  Gene Name: replication protein A1, 70kDa
  ENSP ID: ENSP00000461466
FFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 72649 - protein, 124 aa, Homo sapiens
  Payload ID: 14379
  Gene Symbol: RPA1
  Gene Name: replication protein A1, 70kDa
  ENSP ID: ENSP00000461733
MQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPA

SEQ ID NO: 72650 - protein, 358 aa, Homo sapiens
  Payload ID: 14380
  Gene Symbol: RPA2
  Gene Name: replication protein A2, 32kDa
  Uniprot ID: P15927
  ENSP ID: ENSP00000363015
MWNSNDGGAGWRRKRIAGGFSKRASLGSERRVVAGEEGRERSWGVWGSPAGRRRGRLGRLGQCLKGRSLREPAGFSEAWDVAQALILLFKTGGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 72651 - protein, 278 aa, Homo sapiens
  Payload ID: 14380
  Gene Symbol: RPA2
  Gene Name: replication protein A2, 32kDa
  Uniprot ID: P15927
  ENSP ID: ENSP00000363017
MGRGDRNKRSIRGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 72652 - protein, 270 aa, Homo sapiens
  Payload ID: 14380
  Gene Symbol: RPA2
  Gene Name: replication protein A2, 32kDa
  Uniprot ID: P15927
  ENSP ID: ENSP00000363021
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 72653 - protein, 179 aa, Homo sapiens
  Payload ID: 14380
  Gene Symbol: RPA2
  Gene Name: replication protein A2, 32kDa
  ENSP ID: ENSP00000387649
MWNSNDGGGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQ

SEQ ID NO: 72654 - protein, 122 aa, Homo sapiens
  Payload ID: 14380
  Gene Symbol: RPA2
  Gene Name: replication protein A2, 32kDa
  ENSP ID: ENSP00000413541
LEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 72655 - protein, 121 aa, Homo sapiens
  Payload ID: 14381
  Gene Symbol: RPA3
  Gene Name: replication protein A3, 14kDa
  Uniprot ID: P35244
  ENSP ID: ENSP00000223129
MVDMMDLPRSRINAGMLAQFIDKPVCFVGRLEKIHPTGKMFILSDGEGKNGTIELMEPLDEEISGIVEVVGRVTAKATILCTSYVQFKEDSHPFDLGLYNEAVKIIHDFPQFYPLGIVQHD

SEQ ID NO: 72656 - protein, 121 aa, Homo sapiens; identical to SEQ ID NO: 72655
  Payload ID: 14381
  Gene Symbol: RPA3
  Gene Name: replication protein A3, 14kDa
  Uniprot ID: P35244
  ENSP ID: ENSP00000379914

SEQ ID NO: 72657 - protein, 82 aa, Homo sapiens
  Payload ID: 14381
  Gene Symbol: RPA3
  Gene Name: replication protein A3, 14kDa
  ENSP ID: ENSP00000384652
MFILSDGEGKNGTIELMEPLDEEISGIVEVVGRVTAKATILCTSYVQFKEDSHPFDLGLYNEAVKIIHDFPQFYPLGIVQHD

SEQ ID NO: 72658 - protein, 82 aa, Homo sapiens; identical to SEQ ID NO: 72657
  Payload ID: 14381
  Gene Symbol: RPA3
  Gene Name: replication protein A3, 14kDa
  ENSP ID: ENSP00000385383

SEQ ID NO: 72659 - protein, 261 aa, Homo sapiens
  Payload ID: 14382
  Gene Symbol: RPA4
  Gene Name: replication protein A4, 30kDa
  Uniprot ID: Q13156
  ENSP ID: ENSP00000362131
MSKSGFGSYGSISAADGASGGSDQLCERDATPAIKTQRPKVRIQDVVPCNVNQLLSSTVFDPVFKVRGIIVSQVSIVGVIRGAEKASNHICYKIDDMTAKPIEARQWFGREKVKQVTPLSVGVYVKVFGILKCPTGTKSLEVLKIHVLEDMNEFTVHILETVNAHMMLDKARRDTTVESVPVSPSEVNDAGDNDESHRNFIQDEVLRLIHECPHQEGKSIHELRAQLCDLSVKAIKEAIDYLTVEGHIYPTVDREHFKSAD

SEQ ID NO: 72660 - protein, 336 aa, Homo sapiens
  Payload ID: 14383
  Gene Symbol: RTFDC1
  Gene Name: replication termination factor 2 domain containing 1
  ENSP ID: ENSP00000023939
MGCDGGTIPKRHELVKGPKKVEKIWHLKNGKEWCSLHSEGKNKNGKEWDMEYDVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIMLNGTKEDVDVLKTRMEERRLRAKLEKKTKKPKAAESVSKPDVSEEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 72661 - protein, 306 aa, Homo sapiens
  Payload ID: 14383
  Gene Symbol: RTFDC1
  Gene Name: replication termination factor 2 domain containing 1
  Uniprot ID: Q9BY42
  ENSP ID: ENSP00000349906
MGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIMLNGTKEDVDVLKTRMEERRLRAKLEKKTKKPKAAESVSKPDVSEEAPGPSKVKTGKPEEASLDSREKKTNLAPKSTAMNESSSGKAGKPPCGATKRSIADSEESEAYKSLFTTHSSAKRSKEESAHWVTHTSYCF

SEQ ID NO: 72662 - protein, 230 aa, Homo sapiens
  Payload ID: 14383
  Gene Symbol: RTFDC1
  Gene Name: replication termination factor 2 domain containing 1
  ENSP ID: ENSP00000379220
MGCDGGTIPKRHELVKGPKKVEKVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIMLNGTKEDVDVLKTRMEERRLRAKLEKKPQGHQKLRQGSLKKPALILERRKPTWLPKAQQ

SEQ ID NO: 72663 - protein, 277 aa, Homo sapiens
  Payload ID: 14383
  Gene Symbol: RTFDC1
  Gene Name: replication termination factor 2 domain containing 1
  ENSP ID: ENSP00000400322
MGCDGGTIPKRHELVKGPKKVEKIWHLKNGKEWCSLHSEGKNKNGKEWDMEYDVDKDAELVAQWNYCTLSQEILRRPIVACELGRLYNKDAVIEFLLDKSAEKALGKAASHIKSIKNVTELKLSDNPAWEGDKGNTKGDKHDDLQRARFICPVVGLEMNGRHRFCFLRCCGCVFSERALKEIKAEVCHTCGAAFQEDDVIMLNGTKEDVDVLKTRMEERRLRAKLEKKTKKPKAAESVSKPDVSEEAPGPSKVKTGKPEEASLDSREKKTNLAPKST

SEQ ID NO: 72664 - protein, 2472 aa, Homo sapiens
  Payload ID: 14384
  Gene Symbol: RIF1
  Gene Name: replication timing regulatory factor 1
  Uniprot ID: Q5UIP0
  ENSP ID: ENSP00000243326
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKHNTTSAKGFLSPGSRSPKFKSSKKCLISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 72665 - protein, 2472 aa, Homo sapiens; identical to SEQ ID NO: 72664
  Payload ID: 14384
  Gene Symbol: RIF1
  Gene Name: replication timing regulatory factor 1
  Uniprot ID: Q5UIP0
  ENSP ID: ENSP00000390181

SEQ ID NO: 72666 - protein, 845 aa, Homo sapiens
  Payload ID: 14384
  Gene Symbol: RIF1
  Gene Name: replication timing regulatory factor 1
  ENSP ID: ENSP00000390486
  MOD_RES (1)..(1): Any amino acid
XAGKVELWQRLGAEGQRRREPCPDLPSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRK

SEQ ID NO: 72667 - protein, 746 aa, Homo sapiens
  Payload ID: 14384
  Gene Symbol: RIF1
  Gene Name: replication timing regulatory factor 1
  ENSP ID: ENSP00000404882
  MOD_RES (1)..(1): Any amino acid
XRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKHNTTSAKGFLSPGSRSPKFKSSKKCLISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 72668 - protein, 2446 aa, Homo sapiens
  Payload ID: 14384
  Gene Symbol: RIF1
  Gene Name: replication timing regulatory factor 1
  Uniprot ID: Q5UIP0
  ENSP ID: ENSP00000414615
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 72669 - protein, 2446 aa, Homo sapiens; identical to SEQ ID NO: 72668
  Payload ID: 14384
  Gene Symbol: RIF1
  Gene Name: replication timing regulatory factor 1
  Uniprot ID: Q5UIP0
  ENSP ID: ENSP00000415691

SEQ ID NO: 72670 - protein, 2446 aa, Homo sapiens; identical to SEQ ID NO: 72668
  Payload ID: 14384
  Gene Symbol: RIF1
  Gene Name: replication timing regulatory factor 1
  Uniprot ID: Q5UIP0
  ENSP ID: ENSP00000416123

SEQ ID NO: 72671 - protein, 109 aa, Homo sapiens
  Payload ID: 14385
  Gene Symbol: RPRM
  Gene Name: reprimo, TP53 dependent G2 arrest mediator candidate
  Uniprot ID: Q9NS64
  ENSP ID: ENSP00000314946
MNPALGNQTDVAGLFLANSSEALERAVRCCTQASVVTDDGFAEGGPDERSLYIMRVVQIAVMCVLSLTVVFGIFFLGCNLLIKSEGMINFLVKDRRPSKEVEAVVVGPY

SEQ ID NO: 72672 - protein, 120 aa, Homo sapiens
  Payload ID: 14386
  Gene Symbol: RPRML
  Gene Name: reprimo-like
  Uniprot ID: Q8N4K4
  ENSP ID: ENSP00000318032
MNATFLNHSGLEEVDGVGGGAGAALGNRTHGLGTWLGCCPGGAPLAASDGVPAGLAPDERSLWVSRVAQIAVLCVLSLTVVFGVFFLGCNLLIKSESMINFLVQERRPSKDVGAAILGLY

SEQ ID NO: 72673 - protein, 450 aa, Homo sapiens
  Payload ID: 14387
  Gene Symbol: RGMA
  Gene Name: repulsive guidance molecule family member a
  Uniprot ID: Q96B86
  ENSP ID: ENSP00000330005
MQPPRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 72674 - protein, 434 aa, Homo sapiens
  Payload ID: 14387
  Gene Symbol: RGMA
  Gene Name: repulsive guidance molecule family member a
  Uniprot ID: Q96B86
  ENSP ID: ENSP00000404442
MGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 72675 - protein, 434 aa, Homo sapiens; identical to SEQ ID NO: 72674
  Payload ID: 14387
  Gene Symbol: RGMA
  Gene Name: repulsive guidance molecule family member a
  Uniprot ID: Q96B86
  ENSP ID: ENSP00000440025

SEQ ID NO: 72676 - protein, 434 aa, Homo sapiens; identical to SEQ ID NO: 72674
  Payload ID: 14387
  Gene Symbol: RGMA
  Gene Name: repulsive guidance molecule family member a
  Uniprot ID: Q96B86
  ENSP ID: ENSP00000442498

SEQ ID NO: 72677 - protein, 61 aa, Homo sapiens
  Payload ID: 14387
  Gene Symbol: RGMA
  Gene Name: repulsive guidance molecule family member a
  ENSP ID: ENSP00000451505
MGMGRGAGRSALGFWPTLAFLLCSFPAAIKRSPGSFCAALEMRRLWNLMSWKERRVQKPLM

SEQ ID NO: 72678 - protein, 90 aa, Homo sapiens
  Payload ID: 14387
  Gene Symbol: RGMA
  Gene Name: repulsive guidance molecule family member a
  ENSP ID: ENSP00000451709
MGMGRGAGRSALGFWPTLAFLLCSFPAATSPCKILKCNSEFWSATSGSHAPASDDTPEFCAALRSYALCTRRTARTCRGDLAYHSAVHGI

SEQ ID NO: 72679 - protein, 458 aa, Homo sapiens
  Payload ID: 14387
  Gene Symbol: RGMA
  Gene Name: repulsive guidance molecule family member a
  ENSP ID: ENSP00000452126
MGGLGPRRAGTSRERLVVTGRAGWMGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 72680 - protein, 46 aa, Homo sapiens
  Payload ID: 14387
  Gene Symbol: RGMA
  Gene Name: repulsive guidance molecule family member a
  ENSP ID: ENSP00000452170
MGMGRGAGRSALGFWPTLAFLLCSFPAAHHHLQELPGVCGPEGVPG

SEQ ID NO: 72681 - protein, 10 aa, Homo sapiens
  Payload ID: 14387
  Gene Symbol: RGMA
  Gene Name: repulsive guidance molecule family member a
  ENSP ID: ENSP00000452350
MGMGRGAGRS

SEQ ID NO: 72682 - protein, 341 aa, Homo sapiens
  Payload ID: 14387
  Gene Symbol: RGMA
  Gene Name: repulsive guidance molecule family member a
  ENSP ID: ENSP00000456290
MSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 72683 - protein, 478 aa, Homo sapiens
  Payload ID: 14388
  Gene Symbol: RGMB
  Gene Name: repulsive guidance molecule family member b
  ENSP ID: ENSP00000308219
MIRKKRKRSAPPGPCRSHGPRPATAPAPPPSPEPTRPAWTGMGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 72684 - protein, 437 aa, Homo sapiens
  Payload ID: 14388
  Gene Symbol: RGMB
  Gene Name: repulsive guidance molecule family member b
  Uniprot ID: Q6NW40
  ENSP ID: ENSP00000423256
MGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 72685 - protein, 238 aa, Homo sapiens
  Payload ID: 14389
  Gene Symbol: RMND1
  Gene Name: required for meiotic nuclear division 1 homolog
  Uniprot ID: Q9NWS8
  ENSP ID: ENSP00000336683
MGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 72686 - protein, 449 aa, Homo sapiens
  Payload ID: 14389
  Gene Symbol: RMND1
  Gene Name: required for meiotic nuclear division 1 homolog
  Uniprot ID: Q9NWS8
  ENSP ID: ENSP00000356272
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSTETFVPKQDFPQVKRPLKASRTRQPSRTNLPVLSVNEDLMHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 72687 - protein, 211 aa, Homo sapiens
  Payload ID: 14389
  Gene Symbol: RMND1
  Gene Name: required for meiotic nuclear division 1 homolog
  ENSP ID: ENSP00000412708
MHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDREN

SEQ ID NO: 72688 - protein, 279 aa, Homo sapiens
  Payload ID: 14389
  Gene Symbol: RMND1
  Gene Name: required for meiotic nuclear division 1 homolog
  ENSP ID: ENSP00000481280
MHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 72689 - protein, 391 aa, Homo sapiens
  Payload ID: 14390
  Gene Symbol: RMND5A
  Gene Name: required for meiotic nuclear division 5 homolog A
  Uniprot ID: Q9H871
  ENSP ID: ENSP00000283632
MDQCVTVERELEKVLHKFSGYGQLCERGLEELIDYTGGLKHEILQSHGQDAELSGTLSLVLTQCCKRIKDTVQKLASDHKDIHSSVSRVGKAIDKNFDSDISSVGIDGCWQADSQRLLNEVMVEHFFRQGMLDVAEELCQESGLSVDPSQKEPFVELNRILEALKVRVLRPALEWAVSNREMLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLKCPYCPMEQSPGDAKQIFF

SEQ ID NO: 72690 - protein, 393 aa, Homo sapiens
  Payload ID: 14391
  Gene Symbol: RMND5B
  Gene Name: required for meiotic nuclear division 5 homolog B
  Uniprot ID: Q96G75
  ENSP ID: ENSP00000320623
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 72691 - protein, 393 aa, Homo sapiens; identical to SEQ ID NO: 72690
  Payload ID: 14391
  Gene Symbol: RMND5B
  Gene Name: required for meiotic nuclear division 5 homolog B
  Uniprot ID: Q96G75
  ENSP ID: ENSP00000420875

SEQ ID NO: 72692 - protein, 77 aa, Homo sapiens
  Payload ID: 14391
  Gene Symbol: RMND5B
  Gene Name: required for meiotic nuclear division 5 homolog B
  ENSP ID: ENSP00000421553
MEQCACVERELDKVLQKFLTYGQHCERSLEELLHYVGQLRAELASAGGWPPLQVPCDSLPEDMGDPKLLSDRVPEGR

SEQ ID NO: 72693 - protein, 62 aa, Homo sapiens
  Payload ID: 14391
  Gene Symbol: RMND5B
  Gene Name: required for meiotic nuclear division 5 homolog B
  ENSP ID: ENSP00000423251
MEQCACVERELDKVLQKFLTYGQHCERSLEELLHYVGQLRAELASAVLPEDQRYGAETGFGP

SEQ ID NO: 72694 - protein, 114 aa, Homo sapiens
  Payload ID: 14391
  Gene Symbol: RMND5B
  Gene Name: required for meiotic nuclear division 5 homolog B
  ENSP ID: ENSP00000424928
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDARE

SEQ ID NO: 72695 - protein, 148 aa, Homo sapiens
  Payload ID: 14391
  Gene Symbol: RMND5B
  Gene Name: required for meiotic nuclear division 5 homolog B
  ENSP ID: ENSP00000425920
MEQCACVERELDKVLQKFLTYGQHCERSLEELLHYVGQLRAELASAALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNV

SEQ ID NO: 72696 - protein, 56 aa, Homo sapiens
  Payload ID: 14391
  Gene Symbol: RMND5B
  Gene Name: required for meiotic nuclear division 5 homolog B
  ENSP ID: ENSP00000426588
MEQCACVERELDKVLQKFLTYGQHCERSLEELLHYVGQLRAELASAALQGTPLSAT

SEQ ID NO: 72697 - protein, 380 aa, Homo sapiens
  Payload ID: 14391
  Gene Symbol: RMND5B
  Gene Name: required for meiotic nuclear division 5 homolog B
  ENSP ID: ENSP00000437630
MADCSLDLPGSSSPPSHLSLLRSWDHRRVPPCPALQGTPLSATLSLVMSQCCRKIKDTVQKLASDHKDIHSSVSRVGKAIDRNFDSEICGVVSDAVWDAREQQQQILQMAIVEHLYQQGMLSVAEELCQESTLNVDLDFKQPFLELNRILEALHEQDLGPALEWAVSHRQRLLELNSSLEFKLHRLHFIRLLAGGPAKQLEALSYARHFQPFARLHQREIQVMMGSLVYLRLGLEKSPYCHLLDSSHWAEICETFTRDACSLLGLSVESPLSVSFASGCVALPVLMNIKAVIEQRQCTGVWNHKDELPIEIELGMKCWYHSVFACPILRQQTSDSNPPIKLICGHVISRDALNKLINGGKLKCPYCPMEQNPADGKRIIF

SEQ ID NO: 72698 - protein, 205 aa, Homo sapiens
  Payload ID: 14392
  Gene Symbol: RERGL
  Gene Name: RERG/RAS-like
  Uniprot ID: Q9H628
  ENSP ID: ENSP00000229002
MSNFLHLKYNEKSVSVTKALTVRFLTKRFIGEYASNFESIYKKHLCLERKQLNLEIYDPCSQTQKAKFSLTSELHWADGFVIVYDISDRSSFAFAKALIYRIREPQTSHCKRAVESAVFLVGNKRDLCHVREVGWEEGQKLALENRCQFCELSAAEQSLEVEMMFIRIIKDILINFKLKEKRRPSGSKSMAKLINNVFGKRRKSV

SEQ ID NO: 72699 - protein, 62 aa, Homo sapiens
  Payload ID: 14392
  Gene Symbol: RERGL
  Gene Name: RERG/RAS-like
  ENSP ID: ENSP00000437490
MNDVKLAVLGGEGTGKSALTVRFLTKRFIGEYASNFESIYKKHLCLERKQLNLEIYDPCSQR

SEQ ID NO: 72700 - protein, 204 aa, Homo sapiens
  Payload ID: 14392
  Gene Symbol: RERGL
  Gene Name: RERG/RAS-like
  ENSP ID: ENSP00000437814
MNDVKLAVLGGEGTGKSALTVRFLTKRFIGEYASNFESIYKKHLCLERKQLNLEIYDPCSQTQKAKFSLTSELHWADGFVIVYDISDRSSFAFAKALIYRIREPQTSHCKRAVESAVFLVGNKRDLCHVREVGWEEGQKLALENRCQFCELSAAEQSLEVEMMFIRIIKDILINFKLKEKRRPSGSKSMAKLINNVFGKRRKSV

SEQ ID NO: 72701 - protein, 108 aa, Homo sapiens
  Payload ID: 14393
  Gene Symbol: RETN
  Gene Name: resistin
  Uniprot ID: Q9HD89
  ENSP ID: ENSP00000221515
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 72702 - protein, 82 aa, Homo sapiens
  Payload ID: 14393
  Gene Symbol: RETN
  Gene Name: resistin
  Uniprot ID: Q9HD89
  ENSP ID: ENSP00000370725
MKALCLLLLPVLGLLVSSKTLCSMEEAINERIQEVAGSLSFAVTGCTCGSACGSWDVRAETTCHCQCAGMDWTGARCCRVQP

SEQ ID NO: 72703 - protein, 82 aa, Homo sapiens; identical to SEQ ID NO: 72702
  Payload ID: 14393
  Gene Symbol: RETN
  Gene Name: resistin
  Uniprot ID: Q9HD89
  ENSP ID: ENSP00000485998

SEQ ID NO: 72704 - protein, 111 aa, Homo sapiens
  Payload ID: 14394
  Gene Symbol: RETNLB
  Gene Name: resistin like beta
  Uniprot ID: Q9BQ08
  ENSP ID: ENSP00000295755
MGPSSCLLLILIPLLQLINPGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 72705 - protein, 485 aa, Homo sapiens
  Payload ID: 14395
  Gene Symbol: RCOR1
  Gene Name: REST corepressor 1
  ENSP ID: ENSP00000262241
MPAMVEKGPEVSGKRRGRNNAAASASAAAASAAASAACASPAATAASGAAASSASAAAASAAAAPNNGQNKSLAAAAPNGNSSSNSWEEGSSGSSSDEEHGGGGMRVGPQYQAVVPDFDPAKLARRSQERDNLGMLVWSPNQNLSEAKLDEYIAIAKEKHGYNMEQALGMLFWHKHNIEKSLADLPNFTPFPDEWTVEDKVLFEQAFSFHGKTFHRIQQMLPDKSIASLVKFYYSWKKTRTKTSVMDRHARKQKREREESEDELEEANGNNPIDIEVDQNKESKKEVPPTETVPQVKKEKHSTQAKNRAKRKPPKGMFLSQEDVEAVSANATAATTVLRQLDMELVSVKRQIQNIKQTNSALKEKLDGGIEPYRLPEVIQKCNARWTTEEQLLAVQAIRKYGRDFQAISDVIGNKSVVQVKNFFVNYRRRFNIDEVLQEWEAEHGKEETNGPSNQKPVKSPDNSIKMPEEEDEAPVLDVRYASAS

SEQ ID NO: 72706 - protein, 35 aa, Homo sapiens
  Payload ID: 14395
  Gene Symbol: RCOR1
  Gene Name: REST corepressor 1
  ENSP ID: ENSP00000454204
QTNSALKEKLDGGIEPYRLPEPSGNMAEIFRQSQT

SEQ ID NO: 72707 - protein, 523 aa, Homo sapiens
  Payload ID: 14396
  Gene Symbol: RCOR2
  Gene Name: REST corepressor 2
  Uniprot ID: Q8IZ40
  ENSP ID: ENSP00000301459
MPSVMEKPSAGSGILSRSRAKTVPNGGQPHSEDDSSEEEHSHDSMIRVGTNYQAVIPECKPESPARYSNKELKGMLVWSPNHCVSDAKLDKYIAMAKEKHGYNIEQALGMLLWHKHDVEKSLADLANFTPFPDEWTVEDKVLFEQAFGFHGKCFQRIQQMLPDKLIPSLVKYYYSWKKTRSRTSVMDRQARRLGGRKDKEDSDELEEGRGGVSEGEPDPADPKREPLPSRPLNARPGPGKKEVQVSQYRHHPLRTRRRPPKGMYLSPEGLTAVSGSPDLANLTLRGLDSQLISLKRQVQSMKQTNSSLRQALEGGIDPLRPPEANTKFNSRWTTDEQLLAVQAIRRYGKDFGAIAEVIGNKTLTQVKTFFVSYRRRFNLEEVLQEWEAEQDGAPGAPVPMEEARRGAPLPAPALEEDDEVQITSVSTSVPRSVPPAPPPPPPPTSLSQPPPLLRPPLPTAPTLLRQPPPLQQGRFLQPRLAPNQPPPPLIRPALAAPRHSARPGPQPPPTLIGTPLEPPAPSL

SEQ ID NO: 72708 - protein, 495 aa, Homo sapiens
  Payload ID: 14397
  Gene Symbol: RCOR3
  Gene Name: REST corepressor 3
  Uniprot ID: Q9P2K3
  ENSP ID: ENSP00000355972
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEAQTPQAPRTLGPSPPAPSSTPTPTAPIATLNQPPPLLRPTLPAAPALHRQPPPLQQQARFIQPRPTLNQPPPPLIRPANSMPPRLNPRPVLSTVGGQQPPSLIGIQTDSQSSLH

SEQ ID NO: 72709 - protein, 436 aa, Homo sapiens
  Payload ID: 14397
  Gene Symbol: RCOR3
  Gene Name: REST corepressor 3
  Uniprot ID: Q9P2K3
  ENSP ID: ENSP00000355973
MPGMMEKGPELLGKNRSANGSAKSPAGGGGSGASSTNGGLHYSEPESGCSSDDEHDVGMRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGTDPTGSSDTGSITSCPIIHSNTNSPYCHSEPASTTSSSNTACCPGSSPAASSTPAAGSVHPAPANFKSASTTSYSPC

SEQ ID NO: 72710 - protein, 449 aa, Homo sapiens
  Payload ID: 14397
  Gene Symbol: RCOR3
  Gene Name: REST corepressor 3
  Uniprot ID: Q9P2K3
  ENSP ID: ENSP00000398558
MPGMMEKGPELLGKNRSANGSAKSPAGGGGSGASSTNGGLHYSEPESGCSSDDEHDVGMRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEVCLCMEFELI

SEQ ID NO: 72711 - protein, 553 aa, Homo sapiens
  Payload ID: 14397
  Gene Symbol: RCOR3
  Gene Name: REST corepressor 3
  Uniprot ID: Q9P2K3
  ENSP ID: ENSP00000413929
MPGMMEKGPELLGKNRSANGSAKSPAGGGGSGASSTNGGLHYSEPESGCSSDDEHDVGMRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEAQTPQAPRTLGPSPPAPSSTPTPTAPIATLNQPPPLLRPTLPAAPALHRQPPPLQQQARFIQPRPTLNQPPPPLIRPANSMPPRLNPRPVLSTVGGQQPPSLIGIQTDSQSSLH

SEQ ID NO: 72712 - protein, 374 aa, Homo sapiens
  Payload ID: 14397
  Gene Symbol: RCOR3
  Gene Name: REST corepressor 3
  ENSP ID: ENSP00000432779
MPGMMEKGPELLGKNRSANGSAKSPAGGGGSGASSTNGGLHYSEPESGCSSDDEHDVGMRVGAEYQARIPEFDPVETRSCYVSQAGLKLRGSSHPPSLASQSAGIIGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQFQASTGSFGLYPLRIWEDYYILLTKCSEC

SEQ ID NO: 72713 - protein, 143 aa, Homo sapiens
  Payload ID: 14397
  Gene Symbol: RCOR3
  Gene Name: REST corepressor 3
  ENSP ID: ENSP00000433441
  MOD_RES (1)..(1): Any amino acid
XDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPEAQTPQAPRTLGPSPPAP

SEQ ID NO: 72714 - protein, 74 aa, Homo sapiens
  Payload ID: 14397
  Gene Symbol: RCOR3
  Gene Name: REST corepressor 3
  ENSP ID: ENSP00000434181
  MOD_RES (1)..(1): Any amino acid
XPNAANTILRQLDMELISLKRQVQNAKQVNSALKQKMEGGIEEFKPPESNQKINARWTTEEQLLAVQGDWLLGK

SEQ ID NO: 72715 - protein, 44 aa, Homo sapiens
  Payload ID: 14397
  Gene Symbol: RCOR3
  Gene Name: REST corepressor 3
  ENSP ID: ENSP00000434605
MRVGAEYQARIPEFDPGATKYTDKDNGGMLVWSPYHSIPDAKCP

SEQ ID NO: 72716 - protein, 86 aa, Homo sapiens
  Payload ID: 14397
  Gene Symbol: RCOR3
  Gene Name: REST corepressor 3
  ENSP ID: ENSP00000436057
MRVGAEYQARIPEFDPGATKYTDKDNGGMLVWSPYHSIPDAKLDEYIAIAKEKHGYNVEQALGMLFWHKHNIEKSLADLPNFTPFP

SEQ ID NO: 72717 - protein, 149 aa, Homo sapiens
  Payload ID: 14397
  Gene Symbol: RCOR3
  Gene Name: REST corepressor 3
  ENSP ID: ENSP00000436838
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLAN

SEQ ID NO: 72718 - protein, 240 aa, Homo sapiens
  Payload ID: 14397
  Gene Symbol: RCOR3
  Gene Name: REST corepressor 3
  ENSP ID: ENSP00000437048
GNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEAQTPQAPRTLGPSPPAPSSTPTPTAPIATLNQPPPLLRPTLPAAPALHRQPPPLQQQARFIQPRPTLNQPPPPLIRPANSMPP

SEQ ID NO: 72719 - protein, 317 aa, Homo sapiens
  Payload ID: 14398
  Gene Symbol: RFPL1
  Gene Name: ret finger protein-like 1
  Uniprot ID: O75677
  ENSP ID: ENSP00000346342
MKRLSLVTTNRLSPHGNFLPLCTFPLAVDMAALFQEASSCPVCSDYLEKPMSLECGCAVCFKCINSLQKEPHGEDLLCCCCSMVSQKNKIRPSWQLERLASHIKELEPKLKKILQMNPRMRKFQVDMTLDADTANNFLLISDDLRSVRSGCITQNRQDLAERFDVSICILGSPRFTCGRHYWEVDVGTSTEWDLGVCRESVHRKGRIHLTTERGFWTVSLRDGSRLSASTVPLTFLFVDRKLQRVGIFLDMGMQNVSFFDAEGGSHVYTFRSVSAEEPLHLFFAPPSPPNGDKSVLSICPVINPGTTDAPVHPGEAK

SEQ ID NO: 72720 - protein, 317 aa, Homo sapiens
  Payload ID: 14399
  Gene Symbol: RFPL2
  Gene Name: ret finger protein-like 2
  Uniprot ID: O75678
  ENSP ID: ENSP00000248980
MKRLSLVTTNRLSPHGNFFTLCTFPLAVDMAALFQEASSCPVCSDYLEKPMSLECGCAVCLKCINSLQKEPHGEDLLCCCSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSATTVPLTFLFVDRKLQRVGIFLDMGMQNVSFFDAESGSHVYTFRSVSAEEPLRPFLAPSVPPNGDQGVLSICPLMNSGTTDAPVRPGEAK

SEQ ID NO: 72721 - protein, 378 aa, Homo sapiens
  Payload ID: 14399
  Gene Symbol: RFPL2
  Gene Name: ret finger protein-like 2
  Uniprot ID: O75678
  ENSP ID: ENSP00000248983
MEVAELGFPETAVSQSRICLCAVLCGHWDFADMMVIRSLSLIRLEGVEGRDPVGGGNLTNKRPSCAPSPQDLSAQWKQLEDRGASSRRVDMAALFQEASSCPVCSDYLEKPMSLECGCAVCLKCINSLQKEPHGEDLLCCCSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSATTVPLTFLFVDRKLQRVGIFLDMGMQNVSFFDAESGSHVYTFRSVSAEEPLRPFLAPSVPPNGDQGVLSICPLMNSGTTDAPVRPGEAK

SEQ ID NO: 72722 - protein, 378 aa, Homo sapiens; identical to SEQ ID NO: 72721
  Payload ID: 14399
  Gene Symbol: RFPL2
  Gene Name: ret finger protein-like 2
  Uniprot ID: O75678
  ENSP ID: ENSP00000383096

SEQ ID NO: 72723 - protein, 76 aa, Homo sapiens
  Payload ID: 14399
  Gene Symbol: RFPL2
  Gene Name: ret finger protein-like 2
  ENSP ID: ENSP00000486618
MEVAELGFPETAVSQSRICLCAVLCGHWDFADMMVIRSLSGHGCTLPRSKQLSRLLRLSGKTNVPGVWMRRLPQVH

SEQ ID NO: 72724 - protein, 94 aa, Homo sapiens
  Payload ID: 14399
  Gene Symbol: RFPL2
  Gene Name: ret finger protein-like 2
  ENSP ID: ENSP00000487290
MEVAELGFPETAVSQSRICLCAVLCGHWDFADMMVIRSLRPERPVEAAGGQRSFQQKSGHGCTLPRSKQLSRLLRLSGKTNVPGVWMRRLPQVH

SEQ ID NO: 72725 - protein, 317 aa, Homo sapiens
  Payload ID: 14400
  Gene Symbol: RFPL3
  Gene Name: ret finger protein-like 3
  Uniprot ID: O75679
  ENSP ID: ENSP00000249007
MKRLSLVTTNRLSPQGNFLPLCTFPLAVDMAALFQEASSCPVCSDYLEKPMSLECGCTVCLKCINSLQKEPHGEDLLCCCCSMVSQRNKIRPNRQLERLVSHIKELEPKLKKILQMNPRMRKFQVDMTLDADTANNFLLISDDLRSVRSGLITQNRQDLAERFDVSVCILGSPRFTCGRHYWEVDVGTSTEWDLGVCRESVHCKGKIQLTTELGFWTVSLRDGSRLSASTVPLTFLLVDRKLQRVGIFLDMGMQNVSFFDAESGSHVYTFRSVSAEEPLRPFLAPSIPPNGDQGVLSICPLMNSGTTDAPVRPGEAK

SEQ ID NO: 72726 - protein, 288 aa, Homo sapiens
  Payload ID: 14400
  Gene Symbol: RFPL3
  Gene Name: ret finger protein-like 3
  Uniprot ID: O75679
  ENSP ID: ENSP00000380609
MAALFQEASSCPVCSDYLEKPMSLECGCTVCLKCINSLQKEPHGEDLLCCCCSMVSQRNKIRPNRQLERLVSHIKELEPKLKKILQMNPRMRKFQVDMTLDADTANNFLLISDDLRSVRSGLITQNRQDLAERFDVSVCILGSPRFTCGRHYWEVDVGTSTEWDLGVCRESVHCKGKIQLTTELGFWTVSLRDGSRLSASTVPLTFLLVDRKLQRVGIFLDMGMQNVSFFDAESGSHVYTFRSVSAEEPLRPFLAPSIPPNGDQGVLSICPLMNSGTTDAPVRPGEAK

SEQ ID NO: 72727 - protein, 287 aa, Homo sapiens
  Payload ID: 14401
  Gene Symbol: RFPL4A
  Gene Name: ret finger protein-like 4A
  Uniprot ID: A6NLU0
  ENSP ID: ENSP00000392936
MAEHFKQIIRCPVCLKDLEEAVQLKCGYACCLQCLNSLQKEPDGEGLLCRFCSVVSQKDDIKPKYKLRALVSIIKELEPKLKSVLTMNPRMRKFQVDMTFDVDTANNYLIISEDLRSFRSGDLSQNRKEQAERFDTALCVLGTPRFTSGRHYWEVDVGTSQVWDVGVCKESVNRQGKIVLSSEHGFLTVGCREGKVFAASTVPMTPLWVSPQLHRVGIFLDVGMRSIAFYNVSDGCHIYTFIEIPVCEPWRPFFAHKRGSQDDQSILSICSVINPSAASAPVSSEGK

SEQ ID NO: 72728 - protein, 287 aa, Homo sapiens
  Payload ID: 14402
  Gene Symbol: RFPL4AL1
  Gene Name: ret finger protein-like 4A-like 1
  Uniprot ID: F8VTS6
  ENSP ID: ENSP00000345151
MAEHFKQIIRCPVCLKDLEEAVQLKCGYACCLQCLNSLQKEPDGEGLLCRFCSVVSQKDDIKPKYKLRALVSIIKELEPKLKSVLTMNPRMRKFQVDMTFDVDTANNYLIISEDLRSFRSGDLSQNRKEQAERFDTALCVLGTPRFTSGRHYWEVDVGTSQVWDVGVCKESVNRQGKIELSSEHGFLTVGCREGKVFAASTVPMTPLWVSPQLHRVGIFLDVGMRSIAFYNVSDGCHINTFIEIPVCEPWRPFFAHKRGSQDDQSILSICSVINPSTASAPVSSEGK

SEQ ID NO: 72729 - protein, 263 aa, Homo sapiens
  Payload ID: 14403
  Gene Symbol: RFPL4B
  Gene Name: ret finger protein-like 4B
  Uniprot ID: Q6ZWI9
  ENSP ID: ENSP00000423391
MAKRLQAELSCPVCLDFFSCSISLSCTHVFCFDCIQRYILENHDFRAMCPLCRDVVKVPALEEWQVSVLTLMTKQHNSRLEQSLHVREELRHFREDVTLDAATASSLLVFSNDLRSAQCKKIHHDLTKDPRLACVLGTPCFSSGQHYWEVEVGEVKSWSLGVCKEPADRKSNDLFPEHGFWISMKAGAIHANTHLERIPASPRLRRVGIFLDADLEEIQFFDVDNNVLIYTHDGFFSLELLCPFFCLELLGEGESGNVLTICP

SEQ ID NO: 72730 - protein, 1072 aa, Homo sapiens
  Payload ID: 14404
  Gene Symbol: RET
  Gene Name: ret proto-oncogene
  Uniprot ID: P07949
  ENSP ID: ENSP00000344798
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 72731 - protein, 1114 aa, Homo sapiens
  Payload ID: 14404
  Gene Symbol: RET
  Gene Name: ret proto-oncogene
  Uniprot ID: P07949
  ENSP ID: ENSP00000347942
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 72732 - protein, 181 aa, Homo sapiens
  Payload ID: 14404
  Gene Symbol: RET
  Gene Name: ret proto-oncogene
  ENSP ID: ENSP00000419080
MAKATSGAAGLRLLLLLLLPLLGKDVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFA

SEQ ID NO: 72733 - protein, 458 aa, Homo sapiens
  Payload ID: 14404
  Gene Symbol: RET
  Gene Name: ret proto-oncogene
  ENSP ID: ENSP00000480088
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCLADLTGDAVSGRDEARSSGLGSQKHPGS

SEQ ID NO: 72734 - protein, 261 aa, Homo sapiens
  Payload ID: 14405
  Gene Symbol: RTBDN
  Gene Name: retbindin
  Uniprot ID: Q9BSG5
  ENSP ID: ENSP00000326253
MDEALETQLKTSRGRFSATESLPTLELLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 72735 - protein, 229 aa, Homo sapiens
  Payload ID: 14405
  Gene Symbol: RTBDN
  Gene Name: retbindin
  Uniprot ID: Q9BSG5
  ENSP ID: ENSP00000376925
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 72736 - protein, 229 aa, Homo sapiens; identical to SEQ ID NO: 72735
  Payload ID: 14405
  Gene Symbol: RTBDN
  Gene Name: retbindin
  Uniprot ID: Q9BSG5
  ENSP ID: ENSP00000416375

SEQ ID NO: 72737 - protein, 214 aa, Homo sapiens
  Payload ID: 14405
  Gene Symbol: RTBDN
  Gene Name: retbindin
  ENSP ID: ENSP00000464869
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSIL

SEQ ID NO: 72738 - protein, 186 aa, Homo sapiens
  Payload ID: 14405
  Gene Symbol: RTBDN
  Gene Name: retbindin
  ENSP ID: ENSP00000465796
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISI

SEQ ID NO: 72739 - protein, 193 aa, Homo sapiens
  Payload ID: 14405
  Gene Symbol: RTBDN
  Gene Name: retbindin
  ENSP ID: ENSP00000466382
MDCRVHMRPIGLTWVLQLTLAWILLEACGGSRPLQARSQQHHGLAADLGKGKLHLAEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGR

SEQ ID NO: 72740 - protein, 239 aa, Homo sapiens
  Payload ID: 14405
  Gene Symbol: RTBDN
  Gene Name: retbindin
  Uniprot ID: Q9BSG5
  ENSP ID: ENSP00000466765
MARQLLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNISISAVPRPRPGRRGREAPSRRSRSPRTSILDAAGSGSGSGSGSGP

SEQ ID NO: 72741 - protein, 130 aa, Homo sapiens
  Payload ID: 14405
  Gene Symbol: RTBDN
  Gene Name: retbindin
  ENSP ID: ENSP00000466805
MDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDI

SEQ ID NO: 72742 - protein, 174 aa, Homo sapiens
  Payload ID: 14405
  Gene Symbol: RTBDN
  Gene Name: retbindin
  ENSP ID: ENSP00000466855
MDCRVHMRPIGLTWVLQLTLAWILLEACGGSRPLQARSQQHHGLAADLGKGKLHLAGDPQASVPKPYLNIQDPSSQGSPLPGPCCPSEMDTTETSGPGNHPERCGVPSPECESFLEHLQRALRSRFRLRLLGVRQAQPLCEELCQAWFANCEDDITCGPTWLPLSEKRGCEPSC

SEQ ID NO: 72743 - protein, 190 aa, Homo sapiens
  Payload ID: 14405
  Gene Symbol: RTBDN
  Gene Name: retbindin
  ENSP ID: ENSP00000467888
MARQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQTFADGTDLCRSALGHALPVAAPGARHCFNI

SEQ ID NO: 72744 - protein, 70 aa, Homo sapiens
  Payload ID: 14405
  Gene Symbol: RTBDN
  Gene Name: retbindin
  ENSP ID: ENSP00000468552
MDCRVHMRPIGLTWVLQLTLAWILLEACGGSRPLQARSQQHHGLAADLGKGKLHLAEMDTTETSGPGNHP

SEQ ID NO: 72745 - protein, 205 aa, Homo sapiens
  Payload ID: 14405
  Gene Symbol: RTBDN
  Gene Name: retbindin
  ENSP ID: ENSP00000468697
MDEALETQLKTSRGRFSATESLPTLELLSQVDMDCRVHMRPIGLTWVLQLTLAWILLEACGGSRPLQARSQQHHGLAADLGKGKLHLAGPCCPSEMDTTETSGPGNHPERCGVPSPECESFLEHLQRALRSRFRLRLLGVRQAQPLCEELCQAWFANCEDDITCGPTWLPLSEKRGCEPSCLTYGQAGVQWRDLSSMQPPPPGFK

SEQ ID NO: 72746 - protein, 113 aa, Homo sapiens
  Payload ID: 14405
  Gene Symbol: RTBDN
  Gene Name: retbindin
  ENSP ID: ENSP00000468769
MDEALETQLKTSRGRFSATESLPTLELLSQVDMDCRVHMRPIGLTWVLQLTLAWILLEACGGSRPLQARSQQHHGLAADLGKGKLHLAGDPQASVPKPYLNIQDPSSQGSPLP

SEQ ID NO: 72747 - protein, 177 aa, Homo sapiens
  Payload ID: 14406
  Gene Symbol: RER1
  Gene Name: retention in endoplasmic reticulum sorting receptor 1
  ENSP ID: ENSP00000302088
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPF

SEQ ID NO: 72748 - protein, 187 aa, Homo sapiens
  Payload ID: 14406
  Gene Symbol: RER1
  Gene Name: retention in endoplasmic reticulum sorting receptor 1
  ENSP ID: ENSP00000367773
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWDASVCGDGRCSCKAGGGRQVPGAGCRCGANLLSPLEGMRLPRASLWLWSVLSSTLSTSRCSGRFW

SEQ ID NO: 72749 - protein, 117 aa, Homo sapiens
  Payload ID: 14406
  Gene Symbol: RER1
  Gene Name: retention in endoplasmic reticulum sorting receptor 1
  ENSP ID: ENSP00000367774
MSEGDSVGESVHGKPSVVYRFFTRLGQIYQSWLDKSTPYTAVRWVVTLGLSFVYMIRVYLLQMTVLRYPPNRTRNSAPSFEGSQSLNFGMRLPRASLWLWSVLSSTLSTSRCSGRFW

SEQ ID NO: 72750 - protein, 117 aa, Homo sapiens; identical to SEQ ID NO: 72749
  Payload ID: 14406
  Gene Symbol: RER1
  Gene Name: retention in endoplasmic reticulum sorting receptor 1
  ENSP ID: ENSP00000367779

SEQ ID NO: 72751 - protein, 158 aa, Homo sapiens
  Payload ID: 14406
  Gene Symbol: RER1
  Gene Name: retention in endoplasmic reticulum sorting receptor 1
  ENSP ID: ENSP00000417000
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLF

SEQ ID NO: 72752 - protein, 196 aa, Homo sapiens
  Payload ID: 14406
  Gene Symbol: RER1
  Gene Name: retention in endoplasmic reticulum sorting receptor 1
  Uniprot ID: O15258
  ENSP ID: ENSP00000464222
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 72753 - protein, 196 aa, Homo sapiens; identical to SEQ ID NO: 72752
  Payload ID: 14406
  Gene Symbol: RER1
  Gene Name: retention in endoplasmic reticulum sorting receptor 1
  Uniprot ID: O15258
  ENSP ID: ENSP00000475168

SEQ ID NO: 72754 - protein, 214 aa, Homo sapiens
  Payload ID: 14406
  Gene Symbol: RER1
  Gene Name: retention in endoplasmic reticulum sorting receptor 1
  ENSP ID: ENSP00000487501
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKPSPARSGTEAASRVARTVLSHC

SEQ ID NO: 72755 - protein, 331 aa, Homo sapiens
  Payload ID: 14407
  Gene Symbol: RCN1
  Gene Name: reticulocalbin 1, EF-hand calcium binding domain
  Uniprot ID: Q15293
  ENSP ID: ENSP00000054950
MARGGRGRRLGLALGLLLALVLAPRVLRAKPTVRKERVVRPDSELGERPPEDNQSFQYDHEAFLGKEDSKTFDQLTPDESKERLGKIVDRIDNDGDGFVTTEELKTWIKRVQKRYIFDNVAKVWKDYDRDKDDKISWEEYKQATYGYYLGNPAEFHDSSDHHTFKKMLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 72756 - protein, 28 aa, Homo sapiens
  Payload ID: 14407
  Gene Symbol: RCN1
  Gene Name: reticulocalbin 1, EF-hand calcium binding domain
  ENSP ID: ENSP00000433237
EILENWNMFVGSQATNYGEDLTKNHDEL

SEQ ID NO: 72757 - protein, 19 aa, Homo sapiens
  Payload ID: 14407
  Gene Symbol: RCN1
  Gene Name: reticulocalbin 1, EF-hand calcium binding domain
  ENSP ID: ENSP00000433249
MLPRDERRFKAADLNGDLT

SEQ ID NO: 72758 - protein, 280 aa, Homo sapiens
  Payload ID: 14407
  Gene Symbol: RCN1
  Gene Name: reticulocalbin 1, EF-hand calcium binding domain
  Uniprot ID: Q15293
  ENSP ID: ENSP00000436422
MTGGEGPLPTAKQATCSPPSSRERNPRRRGSRPRKIVDRIDNDGDGFVTTEELKTWIKRVQKRYIFDNVAKVWKDYDRDKDDKISWEEYKQATYGYYLGNPAEFHDSSDHHTFKKMLPRDERRFKAADLNGDLTATREEFTAFLHPEEFEHMKEIVVLETLEDIDKNGDGFVDQDEYIADMFSHEENGPEPDWVLSEREQFNEFRDLNKDGKLDKDEIRHWILPQDYDHAQAEARHLVYESDKNKDEKLTKEEILENWNMFVGSQATNYGEDLTKNHDEL

SEQ ID NO: 72759 - protein, 57 aa, Homo sapiens
  Payload ID: 14407
  Gene Symbol: RCN1
  Gene Name: reticulocalbin 1, EF-hand calcium binding domain
  ENSP ID: ENSP00000436427
  MOD_RES (1)..(1): Any amino acid
XETLEDIDKNGDGFVDQDEYIDKETSGSVTELSQKPGFIFWLLNSVLSTPPHGLHHE

SEQ ID NO: 72760 - protein, 58 aa, Homo sapiens
  Payload ID: 14407
  Gene Symbol: RCN1
  Gene Name: reticulocalbin 1, EF-hand calcium binding domain
  ENSP ID: ENSP00000436482
MLPRDERRFKAADLNGDLTATREEFTAFLHPEEFEHMKEIVVLETLEDIDKNGDGFVD

SEQ ID NO: 72761 - protein, 335 aa, Homo sapiens
  Payload ID: 14408
  Gene Symbol: RCN2
  Gene Name: reticulocalbin 2, EF-hand calcium binding domain
  Uniprot ID: Q14257
  ENSP ID: ENSP00000319739
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKEFAICKKQSFCFWLLRFNLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 72762 - protein, 216 aa, Homo sapiens
  Payload ID: 14408
  Gene Symbol: RCN2
  Gene Name: reticulocalbin 2, EF-hand calcium binding domain
  ENSP ID: ENSP00000378347
MRLGPRTAALGLLLLCAAAAGAGKAEELHYPLGERRSDYDREALLGVQLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 72763 - protein, 317 aa, Homo sapiens
  Payload ID: 14408
  Gene Symbol: RCN2
  Gene Name: reticulocalbin 2, EF-hand calcium binding domain
  Uniprot ID: Q14257
  ENSP ID: ENSP00000378349
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 72764 - protein, 155 aa, Homo sapiens
  Payload ID: 14408
  Gene Symbol: RCN2
  Gene Name: reticulocalbin 2, EF-hand calcium binding domain
  ENSP ID: ENSP00000453052
  MOD_RES (1)..(1): Any amino acid
XGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKHQCGGLGLHPQSQSA

SEQ ID NO: 72765 - protein, 328 aa, Homo sapiens
  Payload ID: 14409
  Gene Symbol: RCN3
  Gene Name: reticulocalbin 3, EF-hand calcium binding domain
  Uniprot ID: Q96D15
  ENSP ID: ENSP00000270645
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 72766 - protein, 150 aa, Homo sapiens
  Payload ID: 14409
  Gene Symbol: RCN3
  Gene Name: reticulocalbin 3, EF-hand calcium binding domain
  ENSP ID: ENSP00000469727
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVKNFMTWRMQRPTKRCWLGTSGVSGWPTRMGTR

SEQ ID NO: 72767 - protein, 169 aa, Homo sapiens
  Payload ID: 14409
  Gene Symbol: RCN3
  Gene Name: reticulocalbin 3, EF-hand calcium binding domain
  ENSP ID: ENSP00000470540
FQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIALFFSRIYLLTFLLL

SEQ ID NO: 72768 - protein, 58 aa, Homo sapiens
  Payload ID: 14409
  Gene Symbol: RCN3
  Gene Name: reticulocalbin 3, EF-hand calcium binding domain
  ENSP ID: ENSP00000470771
  MOD_RES (1)..(1): Any amino acid
XTERQQFRDFRDLNKDGHLDGSEDGRLSKAEILGNWNMFVGSQATNYGEDLTRHHDEL

SEQ ID NO: 72769 - protein, 776 aa, Homo sapiens
  Payload ID: 14410
  Gene Symbol: RTN1
  Gene Name: reticulon 1
  Uniprot ID: Q16799
  ENSP ID: ENSP00000267484
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 72770 - protein, 208 aa, Homo sapiens
  Payload ID: 14410
  Gene Symbol: RTN1
  Gene Name: reticulon 1
  Uniprot ID: Q16799
  ENSP ID: ENSP00000340716
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 72771 - protein, 193 aa, Homo sapiens
  Payload ID: 14410
  Gene Symbol: RTN1
  Gene Name: reticulon 1
  ENSP ID: ENSP00000378525
MPFLPAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 72772 - protein, 702 aa, Homo sapiens
  Payload ID: 14410
  Gene Symbol: RTN1
  Gene Name: reticulon 1
  ENSP ID: ENSP00000483039
METASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 72773 - protein, 545 aa, Homo sapiens
  Payload ID: 14411
  Gene Symbol: RTN2
  Gene Name: reticulon 2
  Uniprot ID: O75298
  ENSP ID: ENSP00000245923
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 72774 - protein, 472 aa, Homo sapiens
  Payload ID: 14411
  Gene Symbol: RTN2
  Gene Name: reticulon 2
  Uniprot ID: O75298
  ENSP ID: ENSP00000345127
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 72775 - protein, 205 aa, Homo sapiens
  Payload ID: 14411
  Gene Symbol: RTN2
  Gene Name: reticulon 2
  Uniprot ID: O75298
  ENSP ID: ENSP00000398178
MGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 72776 - protein, 271 aa, Homo sapiens
  Payload ID: 14411
  Gene Symbol: RTN2
  Gene Name: reticulon 2
  ENSP ID: ENSP00000466619
MEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 72777 - protein, 276 aa, Homo sapiens
  Payload ID: 14411
  Gene Symbol: RTN2
  Gene Name: reticulon 2
  ENSP ID: ENSP00000467863
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGKQRV

SEQ ID NO: 72778 - protein, 461 aa, Homo sapiens
  Payload ID: 14411
  Gene Symbol: RTN2
  Gene Name: reticulon 2
  ENSP ID: ENSP00000468144
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKE

SEQ ID NO: 72779 - protein, 241 aa, Homo sapiens
  Payload ID: 14412
  Gene Symbol: RTN3
  Gene Name: reticulon 3
  Uniprot ID: O95197
  ENSP ID: ENSP00000340903
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKDPSKTPWNRQKKGRISTWKPEMQQLLKHHLIVITSLLVL

SEQ ID NO: 72780 - protein, 1013 aa, Homo sapiens
  Payload ID: 14412
  Gene Symbol: RTN3
  Gene Name: reticulon 3
  Uniprot ID: O95197
  ENSP ID: ENSP00000344106
MAEPSAATQSHSISSSSFGAEPSAPGGGGSPGACPALGTKSCSSSCAEGLSSLCSDEPSSEIMTSSFLSSSEIHNTGLTILHGEKSHVLGSQPILAKEGKDHLDLLDMKKMEKPQGTSNNVSDSSVSLAAGVHCDRPSIPASFPEHPAFLSKKIGQVEEQIDKETKNPNGVSSREAKTALDADDRFTLLTAQKPPTEYSKVEGIYTYSLSPSKVSGDDVIEKDSPESPFEVIIDKAAFDKEFKDSYKESTDDFGSWSVHTDKESSEDISETNDKLFPLRNKEAGRYPMSALLSRQFSHTNAALEEVSRCVNDMHNFTNEILTWDLVPQVKQQTDKSSDCITKTTGLDMSEYNSEIPVVNLKTSTHQKTPVCSIDGSTPITKSTGDWAEASLQQENAITGKPVPDSLNSTKEFSIKGVQGNMQKQDDTLAELPGSPPEKCDSLGSGVATVKVVLPDDHLKDEMDWQSSALGEITEADSSGESDDTVIEDITADTSFENNKIQAEKPVSIPSAVVKTGEREIKEIPSCEREEKTSKNFEELVSDSELHQDQPDILGRSPASEAACSKVPDTNVSLEDVSEVAPEKPITTENPKLPSTVSPNVFNETEFSLNVTTSAYLESLHGKNVKHIDDSSPEDLIAAFTETRDKGIVDSERNAFKAISEKMTDFKTTPPVEVLHENESGGSEIKDIGSKYSEQSKETNGSEPLGVFPTQGTPVASLDLEQEQLTIKALKELGERQVEKSTSAQRDAELPSEEVLKQTFTFAPESWPQRSYDILERNVKNGSDLGISQKPITIRETTRVDAVSSLSKTELVKKHVLARLLTDFSVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 72781 - protein, 214 aa, Homo sapiens
  Payload ID: 14412
  Gene Symbol: RTN3
  Gene Name: reticulon 3
  Uniprot ID: O95197
  ENSP ID: ENSP00000346492
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKPRLITMLASPEIRPSQLLKRSKQNSLESPKKRQNKYMETRNATVTKTPFNSYNVVTCTMKENTQCQLEPAFQAFFLIWCFLPSFPFNPQYQAQKLMD

SEQ ID NO: 72782 - protein, 255 aa, Homo sapiens
  Payload ID: 14412
  Gene Symbol: RTN3
  Gene Name: reticulon 3
  Uniprot ID: O95197
  ENSP ID: ENSP00000348279
MAEPSAATQSHSISSSSFGAEPSAPGGGGSPGACPALGTKSCSSSCADSFVSSSSSQPVSLFSTSQVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 72783 - protein, 1032 aa, Homo sapiens
  Payload ID: 14412
  Gene Symbol: RTN3
  Gene Name: reticulon 3
  Uniprot ID: O95197
  ENSP ID: ENSP00000367050
MAEPSAATQSHSISSSSFGAEPSAPGGGGSPGACPALGTKSCSSSCADSFVSSSSSQPVSLFSTSQEGLSSLCSDEPSSEIMTSSFLSSSEIHNTGLTILHGEKSHVLGSQPILAKEGKDHLDLLDMKKMEKPQGTSNNVSDSSVSLAAGVHCDRPSIPASFPEHPAFLSKKIGQVEEQIDKETKNPNGVSSREAKTALDADDRFTLLTAQKPPTEYSKVEGIYTYSLSPSKVSGDDVIEKDSPESPFEVIIDKAAFDKEFKDSYKESTDDFGSWSVHTDKESSEDISETNDKLFPLRNKEAGRYPMSALLSRQFSHTNAALEEVSRCVNDMHNFTNEILTWDLVPQVKQQTDKSSDCITKTTGLDMSEYNSEIPVVNLKTSTHQKTPVCSIDGSTPITKSTGDWAEASLQQENAITGKPVPDSLNSTKEFSIKGVQGNMQKQDDTLAELPGSPPEKCDSLGSGVATVKVVLPDDHLKDEMDWQSSALGEITEADSSGESDDTVIEDITADTSFENNKIQAEKPVSIPSAVVKTGEREIKEIPSCEREEKTSKNFEELVSDSELHQDQPDILGRSPASEAACSKVPDTNVSLEDVSEVAPEKPITTENPKLPSTVSPNVFNETEFSLNVTTSAYLESLHGKNVKHIDDSSPEDLIAAFTETRDKGIVDSERNAFKAISEKMTDFKTTPPVEVLHENESGGSEIKDIGSKYSEQSKETNGSEPLGVFPTQGTPVASLDLEQEQLTIKALKELGERQVEKSTSAQRDAELPSEEVLKQTFTFAPESWPQRSYDILERNVKNGSDLGISQKPITIRETTRVDAVSSLSKTELVKKHVLARLLTDFSVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 72784 - protein, 185 aa, Homo sapiens
  Payload ID: 14412
  Gene Symbol: RTN3
  Gene Name: reticulon 3
  ENSP ID: ENSP00000437971
MAEPSAATQSHSISSSSFGAEPSAPGGGGSPGACPALGTKSCSSSCAESSLGSHFVPHPVSLLSFNLRIKIKRMHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLV

SEQ ID NO: 72785 - protein, 236 aa, Homo sapiens
  Payload ID: 14412
  Gene Symbol: RTN3
  Gene Name: reticulon 3
  Uniprot ID: O95197
  ENSP ID: ENSP00000440874
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 72786 - protein, 123 aa, Homo sapiens
  Payload ID: 14412
  Gene Symbol: RTN3
  Gene Name: reticulon 3
  ENSP ID: ENSP00000440960
MAEPSAATQSHSISSSSFGAEPSAPGGGGSPGACPALGTKSCSSSCAVHDLIFWRDVKKTGFVFGTTLIMLLSLAAFSVISVVSYLILALLSVTISFRIYKSVIQAVQKSEEGHPFNWLSSCG

SEQ ID NO: 72787 - protein, 136 aa, Homo sapiens
  Payload ID: 14412
  Gene Symbol: RTN3
  Gene Name: reticulon 3
  ENSP ID: ENSP00000441614
MAEPSAATQSHSISSSSFGAEPSAPGGGGSPGACPALGTKSCSSSCADSFVSSSSSQPVSLFSTSQASFPEHPAFLSKKIGQVEEQIDKETKNPNGVSSREAKTALDADDRFTLLTAQKPPTEYSKVEGIYTYSLS

SEQ ID NO: 72788 - protein, 130 aa, Homo sapiens
  Payload ID: 14412
  Gene Symbol: RTN3
  Gene Name: reticulon 3
  ENSP ID: ENSP00000442080
MAEPSAATQSHSISSSSFGAEPSAPGGGGSPGACPALGTKSCSSSCAAGVHCDRPSIPASFPEHPAFLSKKIGQVEEQIDKETKNPNGVSSREAKTALDADDRFTLLTAQKPPTEYSKVEGIYTYSLSPS

SEQ ID NO: 72789 - protein, 920 aa, Homo sapiens
  Payload ID: 14412
  Gene Symbol: RTN3
  Gene Name: reticulon 3
  Uniprot ID: O95197
  ENSP ID: ENSP00000442733
MAEPSAATQSHSISSSSFGAEPSAPGGGGSPGACPALGTKSCSSSCAASFPEHPAFLSKKIGQVEEQIDKETKNPNGVSSREAKTALDADDRFTLLTAQKPPTEYSKVEGIYTYSLSPSKVSGDDVIEKDSPESPFEVIIDKAAFDKEFKDSYKESTDDFGSWSVHTDKESSEDISETNDKLFPLRNKEAGRYPMSALLSRQFSHTNAALEEVSRCVNDMHNFTNEILTWDLVPQVKQQTDKSSDCITKTTGLDMSEYNSEIPVVNLKTSTHQKTPVCSIDGSTPITKSTGDWAEASLQQENAITGKPVPDSLNSTKEFSIKGVQGNMQKQDDTLAELPGSPPEKCDSLGSGVATVKVVLPDDHLKDEMDWQSSALGEITEADSSGESDDTVIEDITADTSFENNKIQAEKPVSIPSAVVKTGEREIKEIPSCEREEKTSKNFEELVSDSELHQDQPDILGRSPASEAACSKVPDTNVSLEDVSEVAPEKPITTENPKLPSTVSPNVFNETEFSLNVTTSAYLESLHGKNVKHIDDSSPEDLIAAFTETRDKGIVDSERNAFKAISEKMTDFKTTPPVEVLHENESGGSEIKDIGSKYSEQSKETNGSEPLGVFPTQGTPVASLDLEQEQLTIKALKELGERQVEKSTSAQRDAELPSEEVLKQTFTFAPESWPQRSYDILERNVKNGSDLGISQKPITIRETTRVDAVSSLSKTELVKKHVLARLLTDFSVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 72790 - protein, 373 aa, Homo sapiens
  Payload ID: 14413
  Gene Symbol: RTN4
  Gene Name: reticulon 4
  Uniprot ID: Q9NQC3
  ENSP ID: ENSP00000322147
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 72791 - protein, 1192 aa, Homo sapiens
  Payload ID: 14413
  Gene Symbol: RTN4
  Gene Name: reticulon 4
  Uniprot ID: Q9NQC3
  ENSP ID: ENSP00000337838
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAENMDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 72792 - protein, 986 aa, Homo sapiens
  Payload ID: 14413
  Gene Symbol: RTN4
  Gene Name: reticulon 4
  Uniprot ID: Q9NQC3
  ENSP ID: ENSP00000349944
MDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 72793 - protein, 392 aa, Homo sapiens
  Payload ID: 14413
  Gene Symbol: RTN4
  Gene Name: reticulon 4
  Uniprot ID: Q9NQC3
  ENSP ID: ENSP00000350365
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 72794 - protein, 199 aa, Homo sapiens
  Payload ID: 14413
  Gene Symbol: RTN4
  Gene Name: reticulon 4
  Uniprot ID: Q9NQC3
  ENSP ID: ENSP00000378107
MDGQKKNWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 72795 - protein, 986 aa, Homo sapiens; identical to SEQ ID NO: 72792
  Payload ID: 14413
  Gene Symbol: RTN4
  Gene Name: reticulon 4
  Uniprot ID: Q9NQC3
  ENSP ID: ENSP00000378109

SEQ ID NO: 72796 - protein, 986 aa, Homo sapiens; identical to SEQ ID NO: 72792
  Payload ID: 14413
  Gene Symbol: RTN4
  Gene Name: reticulon 4
  Uniprot ID: Q9NQC3
  ENSP ID: ENSP00000384471

SEQ ID NO: 72797 - protein, 345 aa, Homo sapiens [sequence omitted]

SEQ ID NO: 72798 - protein, 986 aa, Homo sapiens; identical to SEQ ID NO: 72792
  Payload ID: 14413
  Gene Symbol: RTN4
  Gene Name: reticulon 4
  Uniprot ID: Q9NQC3
  ENSP ID: ENSP00000385650

SEQ ID NO: 72799 - protein, 203 aa, Homo sapiens
  Payload ID: 14413
  Gene Symbol: RTN4
  Gene Name: reticulon 4
  ENSP ID: ENSP00000397808
  MOD_RES (1)..(1): Any amino acid
XLCLRTSGRWRPVWLEARGEGWGGPWSPVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAK

SEQ ID NO: 72800 - protein, 91 aa, Homo sapiens
  Payload ID: 14413
  Gene Symbol: RTN4
  Gene Name: reticulon 4
  ENSP ID: ENSP00000411628
MDLKEQPGNTISAGQEDFPSVLLETAASLPSLSPLSAASFKEHEYLGNLSTVLPTEGTLQENVSEASKEVSEKAKTLLIDRDLTEFSELEY

SEQ ID NO: 72801 - protein, 127 aa, Homo sapiens
  Payload ID: 14413
  Gene Symbol: RTN4
  Gene Name: reticulon 4
  ENSP ID: ENSP00000489133
LLLSLTVFSIVSVTAYIALALLSVTISFRIYKGVIQAIQKSDEGHPFRAYLESEVAISEELVQKYSNSALGHVNCTIKELRRLFLVDDLVDSLKAQIDHYLGLANKNVKDAMAKIQAKIPGLKRKAE

SEQ ID NO: 72802 - protein, 396 aa, Homo sapiens
  Payload ID: 14414
  Gene Symbol: RTN4IP1
  Gene Name: reticulon 4 interacting protein 1
  Uniprot ID: Q8WWV3
  ENSP ID: ENSP00000358059
MEFLKTCVLRRNACTAVCFWRSKVVQKPSVRRISTTSPRSTVMPAWVIDKYGKNEVLRFTQNMMMPIIHYPNEVIVKVHAASVNPIDVNMRSGYGATALNMKRDPLHVKIKGEEFPLTLGRDVSGVVMECGLDVKYFKPGDEVWAAVPPWKQGTLSEFVVVSGNEVSHKPKSLTHTQAASLPYVALTAWSAINKVGGLNDKNCTGKRVLILGASGGVGTFAIQVMKAWDAHVTAVCSQDASELVRKLGADDVIDYKSGSVEEQLKSLKPFDFILDNVGGSTETWAPDFLKKWSGATYVTLVTPFLLNMDRLGIADGMLQTGVTVGSKALKHFWKGVHYRWAFFMASGPCLDDIAELVDAGKIRPVIEQTFPFSKVPEAFLKVERGHARGKTVINVV

SEQ ID NO: 72803 - protein, 226 aa, Homo sapiens
  Payload ID: 14414
  Gene Symbol: RTN4IP1
  Gene Name: reticulon 4 interacting protein 1
  ENSP ID: ENSP00000444261
MEFLKTCVLRRNACTAVCFWRSKVVQKPSVRRISTTSPRSTVMPAWVIDKYGKNEVLRFTQNMMMPIIHYPNEVIVKVHAASVNPIDVNMRSGYGATALNMKRDPLHVKIKGEEFPLTLGRDVSGVVMECGLDVKYFKPGDEVWAAVPPWKQGTLSEFVVVSGNEVSHKPKSLTHTQAASLPYVALTAWSAINKVGGLNDKNCTGKRISGKESIIAGHFSWPVAHV

SEQ ID NO: 72804 - protein, 473 aa, Homo sapiens
  Payload ID: 14415
  Gene Symbol: RTN4R
  Gene Name: reticulon 4 receptor
  Uniprot ID: Q9BZR6
  ENSP ID: ENSP00000043402
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 72805 - protein, 493 aa, Homo sapiens
  Payload ID: 14415
  Gene Symbol: RTN4R
  Gene Name: reticulon 4 receptor
  ENSP ID: ENSP00000396872
  MOD_RES (1)..(1): Any amino acid
XYRGWVGVSGRLHPSLTVWAQNLPFLRGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 72806 - protein, 559 aa, Homo sapiens
  Payload ID: 14415
  Gene Symbol: RTN4R
  Gene Name: reticulon 4 receptor
  ENSP ID: ENSP00000403535
  MOD_RES (1)..(1): Any amino acid
XVEEGAGCLGGCGTRLLLSPGHTCPPPPPSGIQAPVFEIDVPRGTPAPLQCFLGPVGGTPTGTPRGLLQCGLCVHWSPEEVPAVTSVHSRRPSRSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 72807 - protein, 441 aa, Homo sapiens
  Payload ID: 14416
  Gene Symbol: RTN4RL1
  Gene Name: reticulon 4 receptor-like 1
  Uniprot ID: Q86UN2
  ENSP ID: ENSP00000330631
MLRKGCCVELLLLLVAAELPLGGGCPRDCVCYPAPMTVSCQAHNFAAIPEGIPVDSERVFLQNNRIGLLQPGHFSPAMVTLWIYSNNITYIHPSTFEGFVHLEELDLGDNRQLRTLAPETFQGLVKLHALYLYKCGLSALPAGVFGGLHSLQYLYLQDNHIEYLQDDIFVDLVNLSHLFLHGNKLWSLGPGTFRGLVNLDRLLLHENQLQWVHHKAFHDLRRLTTLFLFNNSLSELQGECLAPLGALEFLRLNGNPWDCGCRARSLWEWLQRFRGSSSAVPCVSPGLRHGQDLKLLRAEDFRNCTGPASPHQIKSHTLTTTDRAARKEHHSPHGPTRSKGHPHGPRPGHRKPGKNCTNPRNRNQISKAGAGKQAPELPDYAPDYQHKFSFDIMPTARPKRKGKCARRTPIRAPSGVQQASSASSLGASLLAWTLGLAVTLR

SEQ ID NO: 72808 - protein, 420 aa, Homo sapiens
  Payload ID: 14417
  Gene Symbol: RTN4RL2
  Gene Name: reticulon 4 receptor-like 2
  Uniprot ID: Q86UN3
  ENSP ID: ENSP00000335397
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQDDLFADLANLSHLFLHGNRLRLLTEHVFRGLGSLDRLLLHGNRLQGVHRAAFRGLSRLTILYLFNNSLASLPGEALADLPSLEFLRLNANPWACDCRARPLWAWFQRARVSSSDVTCATPPERQGRDLRALREADFQACPPAAPTRPGSRARGNSSSNHLYGVAEAGAPPADPSTLYRDLPAEDSRGRQGGDAPTEDDYWGGYGGEDQRGEQMCPGAACQAPPDSRGPALSAGLPSPLLCLLLLVPHHL

SEQ ID NO: 72809 - protein, 193 aa, Homo sapiens
  Payload ID: 14417
  Gene Symbol: RTN4RL2
  Gene Name: reticulon 4 receptor-like 2
  Uniprot ID: Q86UN3
  ENSP ID: ENSP00000378552
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQGPLPKGLCSCFSHPPSSLPTSR

SEQ ID NO: 72810 - protein, 204 aa, Homo sapiens
  Payload ID: 14417
  Gene Symbol: RTN4RL2
  Gene Name: reticulon 4 receptor-like 2
  ENSP ID: ENSP00000435606
MLPGLRRLLQAPASACLLLMLLALPLAAPSCPMLCTCYSSPPTVSCQANNFSSVPLSLPPSTQRLFLQNNLIRTLRPGTFGSNLLTLWLFSNNLSTIYPGTFRHLQALEELDLGDNRHLRSLEPDTFQGLERLQSLHLYRCQLSSLPGNIFRGLVSLQYLYLQENSLLHLQGKKEKGKSLLCSWRMDALKMEGIPVIVIHCYYY

SEQ ID NO: 72811 - protein, 104 aa, Homo sapiens
  Payload ID: 14418
  Gene Symbol: RAX
  Gene Name: retina and anterior neural fold homeobox
  Uniprot ID: Q9Y2V3
  ENSP ID: ENSP00000256852
MHLPGCAPAMADGSFSLAGHLLRSPGGSTSRLHSIEAILGFTKDDGILGTFPAERGARGAKERDRRLGARPACPKAPEEGSEPSPPPAPAPAPEYEGVVPEPTG

SEQ ID NO: 72812 - protein, 346 aa, Homo sapiens
  Payload ID: 14418
  Gene Symbol: RAX
  Gene Name: retina and anterior neural fold homeobox
  Uniprot ID: Q9Y2V3
  ENSP ID: ENSP00000334813
MHLPGCAPAMADGSFSLAGHLLRSPGGSTSRLHSIEAILGFTKDDGILGTFPAERGARGAKERDRRLGARPACPKAPEEGSEPSPPPAPAPAPEYEAPRPYCPKEPGEARPSPGLPVGPATGEAKLSEEEQPKKKHRRNRTTFTTYQLHELERAFEKSHYPDVYSREELAGKVNLPEVRVQVWFQNRRAKWRRQEKLEVSSMKLQDSPLLSFSRSPPSATLSPLGAGPGSGGGPAGGALPLESWLGPPLPGGGATALQSLPGFGPPAQSLPASYTPPPPPPPFLNSPPLGPGLQPLAPPPPSYPCGPGFGDKFPLDEADPRNSSIAALRLKAKEHIQAIGKPWQAL

SEQ ID NO: 72813 - protein, 74 aa, Homo sapiens
  Payload ID: 14418
  Gene Symbol: RAX
  Gene Name: retina and anterior neural fold homeobox
  ENSP ID: ENSP00000450583
MHLPGCAPAMADGSFSLAGHLLRSPGGSTSRLHSIEAILGFTKDDGILGTFPAERGARGAKERDRRLGARPACP

SEQ ID NO: 72814 - protein, 184 aa, Homo sapiens
  Payload ID: 14419
  Gene Symbol: RAX2
  Gene Name: retina and anterior neural fold homeobox 2
  Uniprot ID: Q96IS3
  ENSP ID: ENSP00000450456
MFLSPGEGPATEGGGLGPGEEAPKKKHRRNRTTFTTYQLHQLERAFEASHYPDVYSREELAAKVHLPEVRVQVWFQNRRAKWRRQERLESGSGAVAAPRLPEAPALPFARPPAMSLPLEPWLGPGPPAVPGLPRLLGPGPGLQASFGPHAFAPTFADGFALEEASLRLLAKEHAQALDRAWPPA

SEQ ID NO: 72815 - protein, 184 aa, Homo sapiens; identical to SEQ ID NO: 72814
  Payload ID: 14419
  Gene Symbol: RAX2
  Gene Name: retina and anterior neural fold homeobox 2
  Uniprot ID: Q96IS3
  ENSP ID: ENSP00000450687

SEQ ID NO: 72816 - protein, 195 aa, Homo sapiens
  Payload ID: 14420
  Gene Symbol: RD3
  Gene Name: retinal degeneration 3
  Uniprot ID: Q7Z3Z2
  ENSP ID: ENSP00000355969
MSLISWLRWNEAPSRLSTRSPAEMVLETLMMELTGQMREAERQQRERSNAVRKVCTGVDYSWLASTPRSTYDLSPIERLQLEDVCVKIHPSYCGPAILRFRQLLAEQEPEVQEVSQLFRSVLQEVLERMKQEEEAHKLTRQWSLRPRGSLATFKTRARISPFASDIRTISEDVERDTPPPLRSWSMPEFRAPKAD

SEQ ID NO: 72817 - protein, 198 aa, Homo sapiens
  Payload ID: 14421
  Gene Symbol: RD3L
  Gene Name: retinal degeneration 3-like
  Uniprot ID: P0DJH9
  ENSP ID: ENSP00000455434
MPLFGWMKWPKNDSYKPTHYPGSDIVTKTLLRELKWHLKERERLIQEIENEQKVKKTGVDYNWLRNYQNPHTTIPVTEQRQLEVLCSQVQPCQTGTILSRFREVLAENDVLPWEIVYIFKQVLKDFLSSSDRGSEQEDLEDSGSMDCSAPSVIQGDSSKRADKDEIPTISSYVDKNTKDRFPVFSHRIWNLPYYHPSS

SEQ ID NO: 72818 - protein, 253 aa, Homo sapiens
  Payload ID: 14422
  Gene Symbol: RGR
  Gene Name: retinal G protein coupled receptor
  Uniprot ID: P47804
  ENSP ID: ENSP00000350823
MAETSALPTGFGELEVLAVGMVLLVEALSGLSLNTLTIFSFCKTPELRTPCHLLVLSLALADSGISLNALVAATSSLLRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVPALIAKMVPTINAINYALGNEMVCRGIWQCLSPQKREKDRTK

SEQ ID NO: 72819 - protein, 295 aa, Homo sapiens
  Payload ID: 14422
  Gene Symbol: RGR
  Gene Name: retinal G protein coupled receptor
  Uniprot ID: P47804
  ENSP ID: ENSP00000352427
MAETSALPTGFGELEVLAVGMVLLVEALSGLSLNTLTIFSFCKTPELRTPCHLLVLSLALADSGISLNALVAATSSLLRVSHRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVNTTLPARTLLLGWGPYAILYLYAVIADVTSISPKLQMVPALIAKMVPTINAINYALGNEMVCRGIWQCLSPQKREKDRTK

SEQ ID NO: 72820 - protein, 120 aa, Homo sapiens
  Payload ID: 14422
  Gene Symbol: RGR
  Gene Name: retinal G protein coupled receptor
  ENSP ID: ENSP00000361164
MAETSALPTGFGELEVLAVGMVLLVEDPGAADSLPPTGAELGSCGQWDQPECPRCSHIQPSPCLPQALALRLGRLPGSRLPGLCDSVGQHLQQCSHRMGALSPLLHPPKCCHRSHHFEWR

SEQ ID NO: 72821 - protein, 351 aa, Homo sapiens
  Payload ID: 14423
  Gene Symbol: ROM1
  Gene Name: retinal outer segment membrane protein 1
  Uniprot ID: Q03395
  ENSP ID: ENSP00000278833
MAPVLPLVLPLQPRIRLAQGLWLLSWLLALAGGVILLCSGHLLVQLRHLGTFLAPSCQFPVLPQAALAAGAVALGTGLVGVGASRASLNAALYPPWRGVLGPLLVAGTAGGGGLLVVGLGLALALPGSLDEALEEGLVTALAHYKDTEVPGHCQAKRLVDELQLRYHCCGRHGYKDWFGVQWVSSRYLDPGDRDVADRIQSNVEGLYLTDGVPFSCCNPHSPRPCLQNRLSDSYAHPLFDPRQPNQNLWAQGCHEVLLEHLQDLAGTLGSMLAVTFLLQALVLLGLRYLQTALEGLGGVIDAGGETQGYLFPSGLKDMLKTAWLQGGVACRPAPEEAPPGEAPPKEDLSEA

SEQ ID NO: 72822 - protein, 105 aa, Homo sapiens
  Payload ID: 14423
  Gene Symbol: ROM1
  Gene Name: retinal outer segment membrane protein 1
  ENSP ID: ENSP00000432151
MGSLSPVATPTHPGLACKTVFQTPTPTPCSIPDNPTKTSGPKGAMRCCWSTCRTWQAHWVACWLSPSYCRLWCSLACGTCKQHWRGLEGSLMREERPRAISFPVG

SEQ ID NO: 72823 - protein, 100 aa, Homo sapiens
  Payload ID: 14423
  Gene Symbol: ROM1
  Gene Name: retinal outer segment membrane protein 1
  ENSP ID: ENSP00000432983
MGSLSPVATPTHPGLACKTVFQTPTPTPCSIPDNPTKTSGPKGAMRCCWSTCRTWQAHWVACWLSPSYCRLWCSLACGTCKQHWRGLEGSLMREERPRAI

SEQ ID NO: 72824 - protein, 58 aa, Homo sapiens
  Payload ID: 14423
  Gene Symbol: ROM1
  Gene Name: retinal outer segment membrane protein 1
  ENSP ID: ENSP00000433566
MGSLSPVATPTHPGLACKTVFQTPTPTPCSIPDNPTKTSGPKGAMRCCWSTCRTWQAH

SEQ ID NO: 72825 - protein, 337 aa, Homo sapiens
  Payload ID: 14424
  Gene Symbol: RRH
  Gene Name: retinal pigment epithelium-derived rhodopsin homolog
  Uniprot ID: O14718
  ENSP ID: ENSP00000314992
MLRNNLGNSSDSKNEDGSVFSQTEHNIVATYLIMAGMISIISNIIVLGIFIKYKELRTPTNAIIINLAVTDIGVSSIGYPMSAASDLYGSWKFGYAGCQVYAGLNIFFGMASIGLLTVVAVDRYLTICLPDVGRRMTTNTYIGLILGAWINGLFWALMPIIGWASYAPDPTGATCTINWRKNDRSFVSYTMTVIAINFIVPLTVMFYCYYHVTLSIKHHTTSDCTESLNRDWSDQIDVTKMSVIMICMFLVAWSPYSIVCLWASFGDPKKIPPPMAIIAPLFAKSSTFYNPCIYVVANKKFRRAMLAMFKCQTHQTMPVTSILPMDVSQNPLASGRI

SEQ ID NO: 72826 - protein, 533 aa, Homo sapiens
  Payload ID: 14425
  Gene Symbol: RPE65
  Gene Name: retinal pigment epithelium-specific protein 65kDa
  Uniprot ID: Q16518
  ENSP ID: ENSP00000262340
MSIQVEHPAGGYKKLFETVEELSSPLTAHVTGRIPLWLTGSLLRCGPGLFEVGSEPFYHLFDGQALLHKFDFKEGHVTYHRRFIRTDAYVRAMTEKRIVITEFGTCAFPDPCKNIFSRFFSYFRGVEVTDNALVNVYPVGEDYYACTETNFITKINPETLETIKQVDLCNYVSVNGATAHPHIENDGTVYNIGNCFGKNFSIAYNIVKIPPLQADKEDPISKSEIVVQFPCSDRFKPSYVHSFGLTPNYIVFVETPVKINLFKFLSSWSLWGANYMDCFESNETMGVWLHIADKKRKKYLNNKYRTSPFNLFHHINTYEDNGFLIVDLCCWKGFEFVYNYLYLANLRENWEEVKKNARKAPQPEVRRYVLPLNIDKADTGKNLVTLPNTTATAILCSDETIWLEPEVLFSGPRQAFEFPQINYQKYCGKPYTYAYGLGLNHFVPDRLCKLNVKTKETWVWQEPDSYPSEPIFVSHPDALEEDDGVVLSVVVSPGAGQKPAYLLILNAKDLSEVARAEVEINIPVTFHGLFKKS

SEQ ID NO: 72827 - protein, 317 aa, Homo sapiens
  Payload ID: 14426
  Gene Symbol: RLBP1
  Gene Name: retinaldehyde binding protein 1
  Uniprot ID: P12271
  ENSP ID: ENSP00000268125
MSEGVGTFRMVPEEEQELRAQLEQLTTKDHGPVFGPCSQLPRHTLQKAKDELNEREETREEAVRELQEMVQAQAASGEELAVAVAERVQEKDSGFFLRFIRARKFNVGRAYELLRGYVNFRLQYPELFDSLSPEAVRCTIEAGYPGVLSSRDKYGRVVMLFNIENWQSQEITFDEILQAYCFILEKLLENEETQINGFCIIENFKGFTMQQAASLRTSDLRKMVDMLQDSFPARFKAIHFIHQPWYFTTTYNVVKPFLKSKLLERVFVHGDDLSGFYQEIDENILPSDFGGTLPKYDGKAVAEQLFGPQAQAENTAF

SEQ ID NO: 72828 - protein, 108 aa, Homo sapiens
  Payload ID: 14426
  Gene Symbol: RLBP1
  Gene Name: retinaldehyde binding protein 1
  ENSP ID: ENSP00000454740
  MOD_RES (1)..(1): Any amino acid
XNGFCIIENFKGFTMQQAASLRTSDLRKMVDMLQPWYFTTTYNVVKPFLKSKLLERVFVHGDDLSGFYQEIDENILPSDFGGTLPKYDGKAVAEQLFGPQAQAENTAF

SEQ ID NO: 72829 - protein, 71 aa, Homo sapiens
  Payload ID: 14426
  Gene Symbol: RLBP1
  Gene Name: retinaldehyde binding protein 1
  ENSP ID: ENSP00000457251
MSEGVGTFRMVPEEEQELRAQLEQLTTKDHGPVFGPCSQLPRHTLQKAKDELNEREETREEPVPRGCPLHH

SEQ ID NO: 72830 - protein, 2156 aa, Homo sapiens
  Payload ID: 14427
  Gene Symbol: RP1
  Gene Name: retinitis pigmentosa 1 (autosomal dominant)
  Uniprot ID: P56715
  ENSP ID: ENSP00000220676
MSDTPSTGFSIIHPTSSEGQVPPPRHLSLTHPVVAKRISFYKSGDPQFGGVRVVVNPRSFKSFDALLDNLSRKVPLPFGVRNISTPRGRHSITRLEELEDGESYLCSHGRKVQPVDLDKARRRPRPWLSSRAISAHSPPHPVAVAAPGMPRPPRSLVVFRNGDPKTRRAVLLSRRVTQSFEAFLQHLTEVMQRPVVKLYATDGRRVPSLQAVILSSGAVVAAGREPFKPGNYDIQKYLLPARLPGISQRVYPKGNAKSESRKISTHMSSSSRSQIYSVSSEKTHNNDCYLDYSFVPEKYLALEKNDSQNLPIYPSEDDIEKSIIFNQDGTMTVEMKVRFRIKEEETIKWTTTVSKTGPSNNDEKSEMSFPGRTESRSSGLKLAACSFSADVSPMERSSNQEGSLAEEINIQMTDQVAETCSSASWENATVDTDIIQGTQDQAKHRFYRPPTPGLRRVRQKKSVIGSVTLVSETEVQEKMIGQFSYSEERESGENKSEYHMFTHSCSKMSSVSNKPVLVQINNNDQMEESSLERKKENSLLKSSAISAGVIEITSQKMLEMSHNNGLPSTISNNSIVEEDVVDCVVLDNKTGIKNFKTYGNTNDRFSPISADATHFSSNNSGTDKNISEAPASEASSTVTARIDRLINEFAQCGLTKLPKNEKKILSSVASKKKKKSRQQAINSRYQDGQLATKGILNKNERINTKGRITKEMIVQDSDSPLKGGILCEEDLQKSDTVIESNTFCSKSNLNSTISKNFHRNKLNTTQNSKVQGLLTKRKSRSLNKISLGAPKKREIGQRDKVFPHNESKYCKSTFENKSLFHVFNILEQKPKDFYAPQSQAEVASGYLRGMAKKSLVSKVTDSHITLKSQKKRKGDKVKASAILSKQHATTRANSLASLKKPDFPEAIAHHSIQNYIQSWLQNINPYPTLKPIKSAPVCRNETSVVNCSNNSFSGNDPHTNSGKISNFVMESNKHITKIAGLTGDNLCKEGDKSFIANDTGEEDLHETQVGSLNDAYLVPLHEHCTLSQSAINDHNTKSHIAAEKSGPEKKLVYQEINLARKRQSVEAAIQVDPIEEETPKDLLPVLMLHQLQASVPGIHKTQNGVVQMPGSLAGVPFHSAICNSSTNLLLAWLLVLNLKGSMNSFCQVDAHKATNKSSETLALLEILKHIAITEEADDLKAAVANLVESTTSHFGLSEKEQDMVPIDLSANCSTVNIQSVPKCSENERTQGISSLDGGCSASEACAPEVCVLEVTCSPCEMCTVNKAYSPKETCNPSDTFFPSDGYGVDQTSMNKACFLGEVCSLTDTVFSDKACAQKENHTYEGACPIDETYVPVNVCNTIDFLNSKENTYTDNLDSTEELERGDDIQKDLNILTDPEYKNGFNTLVSHQNVSNLSSCGLCLSEKEAELDKKHSSLDDFENCSLRKFQDENAYTSFDMEEPRTSEEPGSITNSMTSSERNISELESFEELENHDTDIFNTVVNGGEQATEELIQEEVEASKTLELIDISSKNIMEEKRMNGIIYEIISKRLATPPSLDFCYDSKQNSEKETNEGETKMVKMMVKTMETGSYSESSPDLKKCIKSPVTSDWSDYRPDSDSEQPYKTSSDDPNDSGELTQEKEYNIGFVKRAIEKLYGKADIIKPSFFPGSTRKSQVCPYNSVEFQCSRKASLYDSEGQSFGSSEQVSSSSSMLQEFQEERQDKCDVSAVRDNYCRGDIVEPGTKQNDDSRILTDIEEGVLIDKGKWLLKENHLLRMSSENPGMCGNADTTSVDTLLDNNSSEVPYSHFGNLAPGPTMDELSSSELEELTQPLELKCNYFNMPHGSDSEPFHEDLLDVRNETCAKERIANHHTEEKGSHQSERVCTSVTHSFISAGNKVYPVSDDAIKNQPLPGSNMIHGTLQEADSLDKLYALCGQHCPILTVIIQPMNEEDRGFAYRKESDIENFLGFYLWMKIHPYLLQTDKNVFREENNKASMRQNLIDNAIGDIFDQFYFSNTFDLMGKRRKQKRINFLGLEEEGNLKKFQPDLKERFCMNFLHTSLLVVGNVDSNTQDLSGQTNEIFKAVDENNNLLNNRFQGSRTNLNQVVRENINCHYFFEMLGQACLLDICQVETSLNISNRNILELCMFEGENLFIWEEEDILNLTDLESSREQEDL

SEQ ID NO: 72831 - protein, 2400 aa, Homo sapiens
  Payload ID: 14428
  Gene Symbol: RP1L1
  Gene Name: retinitis pigmentosa 1-like 1
  ENSP ID: ENSP00000371923
MNSTPRNAQAPSHRECFLPSVARTPSVTKVTPAKKITFLKRGDPRFAGVRLAVHQRAFKTFSALMDELSQRVPLSFGVRSVTTPRGLHSLSALEQLEDGGCYLCSDKKPPKTPSGPGRPQERNPTAQQLRDVEGQREAPGTSSSRKSLKTPRRILLIKNMDPRLQQTVVLSHRNTRNLAAFLGKASDLLRFPVKQLYTTSGKKVDSLQALLHSPSVLVCAGHEAFRTPAMKNARRSEAETLSGLTSRNKNGSWGPKTKPSVIHSRSPPGSTPRLPERPGPSNPPVGPAPGRHPQDTPAQSGPLVAGDDMKKKVRMNEDGSLSVEMKVRFHLVGEDTLLWSRRMGRASALTAASGEDPVLGEVDPLCCVWEGYPWGFSEPGVWGPRPCRVGCREVFGRGGQPGPKYEIWTNPLHASQGERVAARKRWGLAQHVRCSGLWGHGTAGRERCSQDSASPASSTGLPEGSEPESSCCPRTPEDGVDSASPSAQIGAERKAGGSLGEDPGLCIDGAGLGGPEQGGRLTPRARSEEGASSDSSASTGSHEGSSEWGGRPQGCPGKARAETSQQEASEGGDPASPALSLSSLRSDDLQAETQGQGTEQATGAAVTREPLVLGLSCSWDSEGASSTPSTCTSSQQGQRRHRSRASAMSSPSSPGLGRVAPRGHPRHSHYRKDTHSPLDSSVTKQVPRPPERRRACQDGSVPRYSGSSSSTRTQASGNLRPPSSGSLPSQDLLGTSSATVTPAVHSDFVSGVSPHNAPSAGWAGDAGSRTCSPAPIPPHTSDSCSKSGAASLGEEARDTPQPSSPLVLQVGRPEQGAVGPHRSHCCSQPGTQPAQEAQRGPSPEASWLCGRYCPTPPRGRPCPQRRSSSCGSTGSSHQSTARGPGGSPQEGTRQPGPTPSPGPNSGASRRSSASQGAGSRGLSEEKTLRSGGGPQGQEEASGVSPSSLPRSSPEAVVREWLDNIPEEPILMTYELADETTGAAGGGLRGPEVDPGDDHSLEGLGEPAQAGQQSLEGDPGQDPEPEGALLGSSDTGPQSGEGVPQGAAPEGVSEAPAEAGADREAPAGCRVSLRALPGRVSASTQIMRALMGSKQGRPSSVPEVSRPMARRLSCSAGALITCLASLQLFEEDLGSPASKVRFKDSPRYQELLSISKDLWPGCDVGEDQLDSGLWELTWSQALPDLGSHAMTENFTPTSSSGVDISSGSGGSGESSVPCAMDGTLVTQGTELPLKTSNQRPDSRTYESPGDLENQQQCCFPTFLNARACACATNEDEAERDSEEQRASSNLEQLAENTVQEEVQLEETKEGTEGEGLQEEAVQLEETKTEEGLQEEGVQLEETKETEGEGQQEEEAQLEEIEETGGEGLQEEGVQLEEVKEGPEGGLQGEALEEGLKEEGLPEEGSVHGQELSEASSPDGKGSQEDDPVQEEEAGRASASAEPCPAEGTEEPTEPPSHLSETDPSASERQSGSQLEPGLEKPPGATMMGQEHTQAQPTQGAAERSSSVACSAALDCDPIWVSVLLKKTEKAFLAHLASAVAELRARWGLQDNDLLDQMAAELQQDVAQRLQDSTKRELQKLQGRAGRMVLEPPREALTGELLLQTQQRRHRLRGLRNLSAFSERTLGLGPLSFTLEDEPALSTALGSQLGEEAEGEEFCPCEACVRKKVSPMSPKATMGATRGPIKEAFDLQQILQRKRGEHTDGEAAEVAPGKTHTDPTSTRTVQGAEGGLGPGLSQGPGVDEGEDGEGSQRLNRDKDPKLGEAEGDAMAQEREGKTHNSETSAGSELGEAEQEGEGISERGETGGQGSGHEDNLQGEAAAGGDQDPGQSDGAEGIEAPEAEGEAQPESEGVEAPEAEGDAQEAEGEAQPESEDVEAPEAEGEAQPESEDVETPEAEWEVQPESEGAEAPEAEKEAQPETESVEALETEGEDEPESEGAEAQEAEEAAQEAEGQTQPESEVIESQEAEEEAQPESEDVEALEVEVETQEAEGEAQPESEDVEAPEAEGEMQEAEEEAQPESDGVEAQPKSEGEEAQEVEGETQKTEGDAQPESDGVEAPEAEEEAQEAEGEVQEAEGEAHPESEDVDAQEAEGEAQPESEGVEAPEAEGEAQKAEGIEAPETEGEAQPESEGIEAPEAEGEAQPESEGVEAQDAEGEAQPESEGIEAQEAEEEAQPELEGVEAPEAEGEAQPESEGIEAPEAEGEAQPELEGVEAPEAEEEAQPEPEGVETPEAEGEAQPESEGETQGEKKGSPQVSLGDGQSEEASESSSPVPEDRPTPPPSPGGDTPHQRPGSQTGPSSSRASSWGNCWQKDSENDHVLGDTRSPDAKSTGTPHAERKATRMYPESSTSEQEEAPLGSRTPEQGASEGYDLQEDQALGSLAPTEAVGRADGFGQDDLDF

SEQ ID NO: 72832 - protein, 350 aa, Homo sapiens
  Payload ID: 14429
  Gene Symbol: RP2
  Gene Name: retinitis pigmentosa 2 (X-linked recessive)
  Uniprot ID: O75695
  ENSP ID: ENSP00000218340
MGCFFSKRRKADKESRPENEEERPKQYSWDQREKVDPKDYMFSGLKDETVGRLPGTVAGQQFLIQDCENCNIYIFDHSATVTIDDCTNCIIFLGPVKGSVFFRNCRDCKCTLACQQFRVRDCRKLEVFLCCATQPIIESSSNIKFGCFQWYYPELAFQFKDAGLSIFNNTWSNIHDFTPVSGELNWSLLPEDAVVQDYVPIPTTEELKAVRVSTEANRSIVPISRGQRQKSSDESCLVVLFAGDYTIANARKLIDEMVGKGFFLVQTKEVSMKAEDAQRVFREKAPDFLPLLNKGPVIALEFNGDGAVEVCQLIVNEIFNGTKMFVSESKETASGDVDSFYNFADIQMGI

SEQ ID NO: 72833 - protein, 221 aa, Homo sapiens
  Payload ID: 14430
  Gene Symbol: RP9
  Gene Name: retinitis pigmentosa 9 (autosomal dominant)
  Uniprot ID: Q8TA86
  ENSP ID: ENSP00000297157
MSSRPGREDVGAAGARRPREPPEQELQRRREQKRRRHDAQQLQQLKHLESFYEKPPPGLIKEDETKPEDCIPDVPGNEHAREFLAHAPTKGLWMPLGKEVKVMQCWRCKRYGHRTGDKECPFFIKGNQKLEQFRVAHEDPMYDIIRDNKRHEKDVRIQQLKQLLEDSTSDEDRSSSSSSEGKEKHKKKKKKEKHKKRKKEKKKKKKRKHKSSKSNEGSDSE

SEQ ID NO: 72834 - protein, 166 aa, Homo sapiens
  Payload ID: 14430
  Gene Symbol: RP9
  Gene Name: retinitis pigmentosa 9 (autosomal dominant)
  ENSP ID: ENSP00000411577
MAGAAQHREEKHSALLSYEKPPPGLIKEDETKPEDCIPDVPGNEHAREFLAHAPTKGLWMPLGKEVKVMQCWRCKRYGHRTGDKECPFFIKGNQKLEQFRVAHEDPMYDIIRDNKRHEKDVRIQQLKQLLEDSTSDEDRSSSSSSEGKEKHKKKKKKEKHKKRKKE

SEQ ID NO: 72835 - protein, 815 aa, Homo sapiens
  Payload ID: 14431
  Gene Symbol: RPGR
  Gene Name: retinitis pigmentosa GTPase regulator
  Uniprot ID: Q92834
  ENSP ID: ENSP00000322219
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 72836 - protein, 1020 aa, Homo sapiens
  Payload ID: 14431
  Gene Symbol: RPGR
  Gene Name: retinitis pigmentosa GTPase regulator
  Uniprot ID: Q92834
  ENSP ID: ENSP00000343671
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVGNDTGQVGPQADTDGEGLQKEVYRHENNNGVDQLDAKEIEKESDGGHSQKESEAEEIDSEKETKLAEIAGMKDLREREKSTKKMSPFFGNLPDRGMNTESEENKDFVKKRESCKQDVIFDSERESVEKPDSYMEGASESQQGIADGFQQPEAIEFSSGEKEDDEVETDQNIRYGRKLIEQGNEKETKPIISKSMAKYDFKCDRLSEIPEEKEGAEDSKGNGIEEQEVEANEENVKVHGGRKEKTEILSDDLTDKAEDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 72837 - protein, 1152 aa, Homo sapiens
  Payload ID: 14431
  Gene Symbol: RPGR
  Gene Name: retinitis pigmentosa GTPase regulator
  Uniprot ID: Q92834
  ENSP ID: ENSP00000367766
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEVSEGKAKSVGEAEDGPEGRGDGTCEEGSSGAEHWQDEEREKGEKDKGRGEMERPGEGEKELAEKEEWKKRDGEEQEQKEREQGHQKERNQEMEEGGEEEHGEGEEEEGDREEEEEKEGEGKEEGEGEEVEGEREKEEGERKKEERAGKEEKGEEEGDQGEGEEEETEGRGEEKEEGGEVEGGEVEEGKGEREEEEEEGEGEEEEGEGEEEEGEGEEEEGEGKGEEEGEEGEGEEEGEEGEGEGEEEEGEGEGEEEGEGEGEEEEGEGEGEEEGEGEGEEEEGEGKGEEEGEEGEGEGEEEEGEGEGEDGEGEGEEEEGEWEGEEEEGEGEGEEEGEGEGEEGEGEGEEEEGEGEGEEEEGEEEGEEEGEGEEEGEGEGEEEEEGEVEGEVEGEEGEGEGEEEEGEEEGEEREKEGEGEENRRNREEEEEEEGKYQETGEEENERQDGEEYKKVSKIKGSVKYGKHKTYQKKSVTNTQGNGKEQRSKMPVQSKRLLKNGPSGSKKFWNNVLPHYLELK

SEQ ID NO: 72838 - protein, 142 aa, Homo sapiens
  Payload ID: 14431
  Gene Symbol: RPGR
  Gene Name: retinitis pigmentosa GTPase regulator
  ENSP ID: ENSP00000417336
  MOD_RES (1)..(1): Any amino acid
XTKEAEIDNSSTVESLGETTDILNMTHIMSLNSNEKSLKLSPVQKQKDHEFSKTEELKLEDVDEEINAENVESKKKTVGDDESVPTGYHSKTEGAERTNDDSSAETIEKKEKANLEERAICEYNENPKGYMLDDADSSSLEI

SEQ ID NO: 72839 - protein, 129 aa, Homo sapiens
  Payload ID: 14431
  Gene Symbol: RPGR
  Gene Name: retinitis pigmentosa GTPase regulator
  ENSP ID: ENSP00000417574
  MOD_RES (1)..(1): Any amino acid
XIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERLSLMSSGSLYTINNEMGKQRNKDFN

SEQ ID NO: 72840 - protein, 480 aa, Homo sapiens
  Payload ID: 14431
  Gene Symbol: RPGR
  Gene Name: retinitis pigmentosa GTPase regulator
  Uniprot ID: Q92834
  ENSP ID: ENSP00000418926
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDTHHEPEFQ

SEQ ID NO: 72841 - protein, 646 aa, Homo sapiens
  Payload ID: 14431
  Gene Symbol: RPGR
  Gene Name: retinitis pigmentosa GTPase regulator
  Uniprot ID: Q92834
  ENSP ID: ENSP00000419276
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVEIPEEKEGAEDSKGNGIEEQEVEANEENVKVHGGRKEKTEILSDDLTDKAEYSASHSQIVSV

SEQ ID NO: 72842 - protein, 612 aa, Homo sapiens
  Payload ID: 14432
  Gene Symbol: RPGRIP1
  Gene Name: retinitis pigmentosa GTPase regulator interacting protein 1
  Uniprot ID: Q96KN7
  ENSP ID: ENSP00000372391
MLKLDNKDVISHPLGYPSESLLSIASMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEGILRSHDLPTSGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 72843 - protein, 1286 aa, Homo sapiens
  Payload ID: 14432
  Gene Symbol: RPGRIP1
  Gene Name: retinitis pigmentosa GTPase regulator interacting protein 1
  Uniprot ID: Q96KN7
  ENSP ID: ENSP00000382895
MSHLVDPTSGDLPVRDIDAIPLVLPASKGKNMKTQPPLSRMNREELEDSFFRLREDHMLVKELSWKQQDEIKRLRTTLLRLTAAGRDLRVAEEAAPLSETARRGQKAGWRQRLSMHQRPQMHRLQGHFHCVGPASPRRAQPRVQVGHRQLHTAGAPVPEKPKRGPRDRLSYTAPPSFKEHATNENRGEVASKPSELVSGSNSIISFSSVISMAKPIGLCMPNSAHIMASNTMQVEEPPKSPEKMWPKDENFEQRSSLECAQKAAELRASIKEKVELIRLKKLLHERNASLVMTKAQLTEVQEAYETLLQKNQGILSAAHEALLKQVNELRAELKEESKKAVSLKSQLEDVSILQMTLKEFQERVEDLEKERKLLNDNYDKLLESMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEGILRSHDLPTSEQLKDVAYGTRPLSLCLETLPAHGDEDKVDISLLHQGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 72844 - protein, 143 aa, Homo sapiens
  Payload ID: 14432
  Gene Symbol: RPGRIP1
  Gene Name: retinitis pigmentosa GTPase regulator interacting protein 1
  ENSP ID: ENSP00000450426
LQRKINVCYQEELEAMMTKADNDNRDHKEKLERLTRLLDLKNNRIKQLEEQLKDVAYGTRPLSLCLETLPAHGDEDKVDISLLHQGENLFELHIHQAFLTSAALAQAGDTQPTTFCTYSFYDFETHCTPLSVGPQPLYDFTSQ

SEQ ID NO: 72845 - protein, 943 aa, Homo sapiens
  Payload ID: 14432
  Gene Symbol: RPGRIP1
  Gene Name: retinitis pigmentosa GTPase regulator interacting protein 1
  ENSP ID: ENSP00000450445
MSHLVDPTSGDLPVRDIDAIPLVLPASKGKNMKTQPPLSRMNREELEDSFFRLREDHMLVKELSWKQQDEIKRLRTTLLRLTAAGRDLRVAEEAAPLSETARRGQKAGWRQRLSMHQRPQMHRLQGHFHCVGPASPRRAQPRVQVGHRQLHTAGAPVPEKPKRGPRDRLSYTAPPSFKEHATNENRGEVASKPSELAHIMASNTMQVEEPPKSPEKMWPKDENFEQRSSLECAQKAAELRASIKEKVELIRLKKLLHERNASLVMTKAQLTEVQEAYETLLQKNQGILSAAHEALLKQVNELRAELKEESKKAVSLKSQLEDVSILQMTLKEFQERVEDLEKERKLLNDNYDKLLESMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEGILRSHDLPTSGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 72846 - protein, 26 aa, Homo sapiens
  Payload ID: 14432
  Gene Symbol: RPGRIP1
  Gene Name: retinitis pigmentosa GTPase regulator interacting protein 1
  ENSP ID: ENSP00000450662
  MOD_RES (1)..(1): Any amino acid
XDMLILQRKINVCYQVQGKMVQEGDG

SEQ ID NO: 72847 - protein, 59 aa, Homo sapiens
  Payload ID: 14432
  Gene Symbol: RPGRIP1
  Gene Name: retinitis pigmentosa GTPase regulator interacting protein 1
  ENSP ID: ENSP00000451044
ERLTRLLDLKNNRIKQLEERAPYPLTDRQLSFPSRTAQRCCLWHPTVVVMFGNTASPWR

SEQ ID NO: 72848 - protein, 1248 aa, Homo sapiens
  Payload ID: 14432
  Gene Symbol: RPGRIP1
  Gene Name: retinitis pigmentosa GTPase regulator interacting protein 1
  ENSP ID: ENSP00000451219
MSHLVDPTSGDLPVRDIDAIPLVLPASKGKNMKTQPPLSRMNREELEDSFFRLREDHMLVKELSWKQQDEIKRLRTTLLRLTAAGRDLRVAEEAAPLSETARRGQKAGWRQRLSMHQRPQMHRLQGHFHCVGPASPRRAQPRVQVGHRQLHTAGAPVPEKPKRGPRDRLSYTAPPSFKEHATNENRGEVASKPSELAHIMASNTMQVEEPPKSPEKMWPKDENFEQRSSLECAQKAAELRASIKEKVELIRLKKLLHERNASLVMTKAQLTEVQEAYETLLQKNQGILSAAHEALLKQVNELRAELKEESKKAVSLKSQLEDVSILQMTLKEFQERVEDLEKERKLLNDNYDKLLESMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEEQLKDVAYGTRPLSLCLETLPAHGDEDKVDISLLHQGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 72849 - protein, 761 aa, Homo sapiens
  Payload ID: 14432
  Gene Symbol: RPGRIP1
  Gene Name: retinitis pigmentosa GTPase regulator interacting protein 1
  ENSP ID: ENSP00000451262
MLILQRKINVCYQELEAMMTKADNDNRDHKEKLERLTRLLDLKNNRIKQLEGILRSHDLPTSEQLKDVAYGTRPLSLCLETLPAHGDEDKVDISLLHQGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 72850 - protein, 134 aa, Homo sapiens
  Payload ID: 14432
  Gene Symbol: RPGRIP1
  Gene Name: retinitis pigmentosa GTPase regulator interacting protein 1
  ENSP ID: ENSP00000451719
  MOD_RES (1)..(1): Any amino acid
XNILNGNTPEQVNYTEWKFSETNSFIGDGFKNQHEEEEMTLSHSALKQKEPLHPVNADKESSEQGSEVSEAQTTDSDDVIVPPMSQKYPKADSEKMCIEIVSLAFYPEAEVMSDENIKQVYVEYKFYDLPLSET

SEQ ID NO: 72851 - protein, 166 aa, Homo sapiens
  Payload ID: 14432
  Gene Symbol: RPGRIP1
  Gene Name: retinitis pigmentosa GTPase regulator interacting protein 1
  ENSP ID: ENSP00000452215
MLKLDNKDVISHPLGYPSESLLSIASMLDSSDSSSQPHWSNELIAEQLQQQVSQLQDQLDAELEDKRKVLLELSREKGGVSLLLLRLECNGTISAHCNLHLPAQNEDLKLEVTNILQKHKQEVELLQNAATISQPPDRQSEPATHPAVLQENTQIEPSEPKNQEEK

SEQ ID NO: 72852 - protein, 928 aa, Homo sapiens
  Payload ID: 14433
  Gene Symbol: RB1
  Gene Name: retinoblastoma 1
  Uniprot ID: P06400
  ENSP ID: ENSP00000267163
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 72853 - protein, 53 aa, Homo sapiens
  Payload ID: 14433
  Gene Symbol: RB1
  Gene Name: retinoblastoma 1
  ENSP ID: ENSP00000434702
MPPKTPRKTAATAAAAAAEPPAPPPPPPPEEDPEQDSGPEDLPLVRGSITNGR

SEQ ID NO: 72854 - protein, 410 aa, Homo sapiens
  Payload ID: 14434
  Gene Symbol: RBBP4
  Gene Name: retinoblastoma binding protein 4
  Uniprot ID: Q09028
  ENSP ID: ENSP00000362584
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMELVLDH

SEQ ID NO: 72855 - protein, 425 aa, Homo sapiens
  Payload ID: 14434
  Gene Symbol: RBBP4
  Gene Name: retinoblastoma binding protein 4
  Uniprot ID: Q09028
  ENSP ID: ENSP00000362592
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 72856 - protein, 87 aa, Homo sapiens
  Payload ID: 14434
  Gene Symbol: RBBP4
  Gene Name: retinoblastoma binding protein 4
  ENSP ID: ENSP00000389437
MTHALEWPSLTAQWLPDVTRPEGKDFSIHRLVLGTHTSDEQNHLVIASVQLPNDDAQFDASHYDSEKGEFGGFGSVSGKIEIEIKIN

SEQ ID NO: 72857 - protein, 390 aa, Homo sapiens
  Payload ID: 14434
  Gene Symbol: RBBP4
  Gene Name: retinoblastoma binding protein 4
  Uniprot ID: Q09028
  ENSP ID: ENSP00000396057
MTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 72858 - protein, 424 aa, Homo sapiens
  Payload ID: 14434
  Gene Symbol: RBBP4
  Gene Name: retinoblastoma binding protein 4
  Uniprot ID: Q09028
  ENSP ID: ENSP00000398242
MADKEAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 72859 - protein, 180 aa, Homo sapiens
  Payload ID: 14434
  Gene Symbol: RBBP4
  Gene Name: retinoblastoma binding protein 4
  ENSP ID: ENSP00000432298
VADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 72860 - protein, 104 aa, Homo sapiens
  Payload ID: 14434
  Gene Symbol: RBBP4
  Gene Name: retinoblastoma binding protein 4
  ENSP ID: ENSP00000432774
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGG

SEQ ID NO: 72861 - protein, 62 aa, Homo sapiens
  Payload ID: 14434
  Gene Symbol: RBBP4
  Gene Name: retinoblastoma binding protein 4
  ENSP ID: ENSP00000432780
MADKEAAFDDAVEERVINEEYKIWKKNTPFLYDLVMTHALEWPSLTAQWLPDVTRIWRFWFS

SEQ ID NO: 72862 - protein, 262 aa, Homo sapiens
  Payload ID: 14434
  Gene Symbol: RBBP4
  Gene Name: retinoblastoma binding protein 4
  ENSP ID: ENSP00000433805
  MOD_RES (1)..(1): Any amino acid
XLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMMVSHFFTQAGVQWCNLGSLQLPPPRFDRFSCLSLLSSWDYRQRTFIMMKTLKEAWIQKDKGPRYVFTCCDFRLPFFLLNPESDLTLVLRQTLFSYPSI

SEQ ID NO: 72863 - protein, 87 aa, Homo sapiens
  Payload ID: 14434
  Gene Symbol: RBBP4
  Gene Name: retinoblastoma binding protein 4
  ENSP ID: ENSP00000434925
MADKEAAFDDAVEERVINEEYKIWKKNTPFLYDLVMTHALEWPSLTAQWLPDVTRSFWRVQPRLASPWTSEGRLWAFLEPKSQWALT

SEQ ID NO: 72864 - protein, 167 aa, Homo sapiens
  Payload ID: 14434
  Gene Symbol: RBBP4
  Gene Name: retinoblastoma binding protein 4
  ENSP ID: ENSP00000436565
SKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMGRQRTFIMMKTLKEAWIQKDKGVSP

SEQ ID NO: 72865 - protein, 87 aa, Homo sapiens; identical to SEQ ID NO: 72863
  Payload ID: 14434
  Gene Symbol: RBBP4
  Gene Name: retinoblastoma binding protein 4
  ENSP ID: ENSP00000436663

SEQ ID NO: 72866 - protein, 207 aa, Homo sapiens
  Payload ID: 14434
  Gene Symbol: RBBP4
  Gene Name: retinoblastoma binding protein 4
  ENSP ID: ENSP00000436986
  MOD_RES (1)..(1): Any amino acid
XNPCIIATKTPSSDVLVFDYTKHPSKPGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQM

SEQ ID NO: 72867 - protein, 68 aa, Homo sapiens
  Payload ID: 14434
  Gene Symbol: RBBP4
  Gene Name: retinoblastoma binding protein 4
  ENSP ID: ENSP00000437210
MTHALEWPSLTAQWLPDVTRPEGKDFSIHRLVLGTHTSDEQNHLVIASVQLPNDDAQFDASHYDSEKG

SEQ ID NO: 72868 - protein, 538 aa, Homo sapiens
  Payload ID: 14435
  Gene Symbol: RBBP5
  Gene Name: retinoblastoma binding protein 5
  Uniprot ID: Q15291
  ENSP ID: ENSP00000264515
MNLELLESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKGKEKDSPFKPKLYKGDRGLPLEGSAKGKVQAELSQPLTAGGAISELL

SEQ ID NO: 72869 - protein, 500 aa, Homo sapiens
  Payload ID: 14435
  Gene Symbol: RBBP5
  Gene Name: retinoblastoma binding protein 5
  Uniprot ID: Q15291
  ENSP ID: ENSP00000356132
MNLELLESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKAGGAISELL

SEQ ID NO: 72870 - protein, 1758 aa, Homo sapiens
  Payload ID: 14436
  Gene Symbol: RBBP6
  Gene Name: retinoblastoma binding protein 6
  Uniprot ID: Q7Z6E9
  ENSP ID: ENSP00000316291
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEESKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 72871 - protein, 1792 aa, Homo sapiens
  Payload ID: 14436
  Gene Symbol: RBBP6
  Gene Name: retinoblastoma binding protein 6
  Uniprot ID: Q7Z6E9
  ENSP ID: ENSP00000317872
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 72872 - protein, 952 aa, Homo sapiens
  Payload ID: 14436
  Gene Symbol: RBBP6
  Gene Name: retinoblastoma binding protein 6
  Uniprot ID: Q7Z6E9
  ENSP ID: ENSP00000370427
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 72873 - protein, 118 aa, Homo sapiens
  Payload ID: 14436
  Gene Symbol: RBBP6
  Gene Name: retinoblastoma binding protein 6
  Uniprot ID: Q7Z6E9
  ENSP ID: ENSP00000390537
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAVCKNTISHFFYTLLLPL

SEQ ID NO: 72874 - protein, 1008 aa, Homo sapiens
  Payload ID: 14436
  Gene Symbol: RBBP6
  Gene Name: retinoblastoma binding protein 6
  ENSP ID: ENSP00000456750
MMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLD

SEQ ID NO: 72875 - protein, 300 aa, Homo sapiens
  Payload ID: 14436
  Gene Symbol: RBBP6
  Gene Name: retinoblastoma binding protein 6
  ENSP ID: ENSP00000457716
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCH

SEQ ID NO: 72876 - protein, 158 aa, Homo sapiens
  Payload ID: 14436
  Gene Symbol: RBBP6
  Gene Name: retinoblastoma binding protein 6
  ENSP ID: ENSP00000460821
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPS

SEQ ID NO: 72877 - protein, 138 aa, Homo sapiens
  Payload ID: 14436
  Gene Symbol: RBBP6
  Gene Name: retinoblastoma binding protein 6
  ENSP ID: ENSP00000481477
  MOD_RES (1)..(1): Any amino acid
XKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECKKC

SEQ ID NO: 72878 - protein, 469 aa, Homo sapiens
  Payload ID: 14437
  Gene Symbol: RBBP7
  Gene Name: retinoblastoma binding protein 7
  Uniprot ID: Q16576
  ENSP ID: ENSP00000369424
MAAEAGVVGAGASPDGDWRDQACGLLLHVHLSSRLGRAAPVRTGRHLRTVFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 72879 - protein, 425 aa, Homo sapiens
  Payload ID: 14437
  Gene Symbol: RBBP7
  Gene Name: retinoblastoma binding protein 7
  Uniprot ID: Q16576
  ENSP ID: ENSP00000369427
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 72880 - protein, 416 aa, Homo sapiens
  Payload ID: 14437
  Gene Symbol: RBBP7
  Gene Name: retinoblastoma binding protein 7
  ENSP ID: ENSP00000386068
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 72881 - protein, 285 aa, Homo sapiens
  Payload ID: 14437
  Gene Symbol: RBBP7
  Gene Name: retinoblastoma binding protein 7
  ENSP ID: ENSP00000392714
ARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKVCDSFLVSVCQEMKSRDSSVKLYQTRGSTIEKNVLYVVLHGDAHRVHWSPHNETILASSGTDRRLNVWDL

SEQ ID NO: 72882 - protein, 175 aa, Homo sapiens
  Payload ID: 14437
  Gene Symbol: RBBP7
  Gene Name: retinoblastoma binding protein 7
  ENSP ID: ENSP00000402796
DDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLVRIGL

SEQ ID NO: 72883 - protein, 85 aa, Homo sapiens
  Payload ID: 14437
  Gene Symbol: RBBP7
  Gene Name: retinoblastoma binding protein 7
  ENSP ID: ENSP00000415747
LNVWDLSKIGEEQSAEDAEDGPPELLFIHGGHTAKISDFSWNPNEPWVICSVSEDNIMQIWQMAENIYNDEESDVTTSELEGQGS

SEQ ID NO: 72884 - protein, 37 aa, Homo sapiens
  Payload ID: 14437
  Gene Symbol: RBBP7
  Gene Name: retinoblastoma binding protein 7
  ENSP ID: ENSP00000417507
MAMFEDTVEERVINEEYKIWKKNTPFLYDLVMTHALQ

SEQ ID NO: 72885 - protein, 67 aa, Homo sapiens
  Payload ID: 14437
  Gene Symbol: RBBP7
  Gene Name: retinoblastoma binding protein 7
  ENSP ID: ENSP00000417791
MTHALQWPSLTVQWLPEVTKPEGKDYALHWLVLGTHTSDEQNHLVVARVHIPNDDAQFDASHCDSDK

SEQ ID NO: 72886 - protein, 897 aa, Homo sapiens
  Payload ID: 14438
  Gene Symbol: RBBP8
  Gene Name: retinoblastoma binding protein 8
  Uniprot ID: Q99708
  ENSP ID: ENSP00000323050
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 72887 - protein, 902 aa, Homo sapiens
  Payload ID: 14438
  Gene Symbol: RBBP8
  Gene Name: retinoblastoma binding protein 8
  ENSP ID: ENSP00000354024
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSMLFYIDEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 72888 - protein, 580 aa, Homo sapiens
  Payload ID: 14438
  Gene Symbol: RBBP8
  Gene Name: retinoblastoma binding protein 8
  ENSP ID: ENSP00000382627
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEE

SEQ ID NO: 72889 - protein, 897 aa, Homo sapiens; identical to SEQ ID NO: 72886
  Payload ID: 14438
  Gene Symbol: RBBP8
  Gene Name: retinoblastoma binding protein 8
  Uniprot ID: Q99708
  ENSP ID: ENSP00000382628

SEQ ID NO: 72890 - protein, 867 aa, Homo sapiens
  Payload ID: 14438
  Gene Symbol: RBBP8
  Gene Name: retinoblastoma binding protein 8
  Uniprot ID: Q99708
  ENSP ID: ENSP00000382630
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDESIMQICQQKKEKRNWLPAQDTDSATFHPTHQRIFGKLVFLPLRLVWKEVILRKILILVLVQKDVSLTTQYFLQKARSRRHRR

SEQ ID NO: 72891 - protein, 64 aa, Homo sapiens
  Payload ID: 14438
  Gene Symbol: RBBP8
  Gene Name: retinoblastoma binding protein 8
  ENSP ID: ENSP00000462390
MNISGSSCGSPNSADTSSDFKDLWTKLKECHDREVQGLQVKVTKLKQERILDAQRLEEFFTKNQ

SEQ ID NO: 72892 - protein, 160 aa, Homo sapiens
  Payload ID: 14438
  Gene Symbol: RBBP8
  Gene Name: retinoblastoma binding protein 8
  ENSP ID: ENSP00000463310
  MOD_RES (1)..(1): Any amino acid
XEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMATTVVAETLGLGVQEESET

SEQ ID NO: 72893 - protein, 84 aa, Homo sapiens
  Payload ID: 14438
  Gene Symbol: RBBP8
  Gene Name: retinoblastoma binding protein 8
  ENSP ID: ENSP00000463439
MNISGSSCGSPNSADTSSDFKDLWTKLKECHDREVQGLQVKVTKLKQERILDAQRLEEFFTKNQQLREQQKVLHETIKVLEDRL

SEQ ID NO: 72894 - protein, 75 aa, Homo sapiens
  Payload ID: 14438
  Gene Symbol: RBBP8
  Gene Name: retinoblastoma binding protein 8
  ENSP ID: ENSP00000463544
MPAEEREKKLASCSRHRFRYIPPNTPENFWEVGFPSTQTCMERGYIKEDLDPCPRPKRRQPYNAIFSPKGKEQKT

SEQ ID NO: 72895 - protein, 205 aa, Homo sapiens
  Payload ID: 14438
  Gene Symbol: RBBP8
  Gene Name: retinoblastoma binding protein 8
  ENSP ID: ENSP00000463738
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRK

SEQ ID NO: 72896 - protein, 29 aa, Homo sapiens
  Payload ID: 14438
  Gene Symbol: RBBP8
  Gene Name: retinoblastoma binding protein 8
  ENSP ID: ENSP00000464284
MNISGSSCGSPNSADTSSDFKDLWTKLKE

SEQ ID NO: 72897 - protein, 10 aa, Homo sapiens
  Payload ID: 14438
  Gene Symbol: RBBP8
  Gene Name: retinoblastoma binding protein 8
  ENSP ID: ENSP00000464628
MNISGSSCGS

SEQ ID NO: 72898 - protein, 324 aa, Homo sapiens
  Payload ID: 14438
  Gene Symbol: RBBP8
  Gene Name: retinoblastoma binding protein 8
  ENSP ID: ENSP00000464691
PCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHKRLACKIFLILRWFGKKRREENCLGTRVRNVKFIMQICQQKKEKRNWLPAQDTDSATFHPTHQRIFGKLVFLPLRLVWKEVILRKILILVLVQKDVSLTTQYFLQKARSRRHRR

SEQ ID NO: 72899 - protein, 45 aa, Homo sapiens
  Payload ID: 14438
  Gene Symbol: RBBP8
  Gene Name: retinoblastoma binding protein 8
  ENSP ID: ENSP00000477396
  MOD_RES (1)..(1): Any amino acid
XNKKLSEQLQQKIETILSKSLLLCYLTTLLIHEDSYHGPPESCFL

SEQ ID NO: 72900 - protein, 186 aa, Homo sapiens
  Payload ID: 14439
  Gene Symbol: RBBP9
  Gene Name: retinoblastoma binding protein 9
  Uniprot ID: O75884
  ENSP ID: ENSP00000336866
MASPSKAVIVPGNGGGDVTTHGWYGWVKKELEKIPGFQCLAKNMPDPITARESIWLPFMETELHCDEKTIIIGHSSGAIAAMRYAETHRVYAIVLVSAYTSDLGDENERASGYFTRPWQWEKIKANCPYIVQFGSTDDPFLPWKEQQEVADRLETKLHKFTDCGHFQNTEFHELITVVKSLLKVPA

SEQ ID NO: 72901 - protein, 173 aa, Homo sapiens
  Payload ID: 14439
  Gene Symbol: RBBP9
  Gene Name: retinoblastoma binding protein 9
  ENSP ID: ENSP00000482005
MASPSKAVIVPGNGGGDVTTHGWYGWVKKELEKIPGFQCLAKNMPDPITARESIWLPFMETELHCDEKTIIIGHSSGAIAAMRYAETHRVYAIVLVSAYTSDLGDENERASGYFTRPWQWEKIKANCPYIVQFGSTDDPFLPWKEQQEVADRWKPNCTNSLTVATFRTQSFMN

SEQ ID NO: 72902 - protein, 1014 aa, Homo sapiens
  Payload ID: 14440
  Gene Symbol: RBL1
  Gene Name: retinoblastoma-like 1
  Uniprot ID: P28749
  ENSP ID: ENSP00000343646
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLSLIQFFSKMKKWMDMSNLPQEFRERIERLERNFEVSTVIFKKYEPIFLDIFQNPYEEPPKLPRSRKQRRIPCSVKDLFNFCWTLFVYTKGNFRMIGDDLVNSYHLLLCCLDLIFANAIMCPNRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQPGSHIDFAVNRLKLAEILYYKILETVMVQETRRLHGMDMSVLLEQDIFHRSLMACCLEIVLFAYSSPRTFPWIIEVLNLQPFYFYKVIEVVIRSEEGLSRDMVKHLNSIEEQILESLAWSHDSALWEALQVSANKVPTCEEVIFPNNFETGNGGNVQGHLPLMPMSPLMHPRVKEVRTDSGSLRRDMQPLSPISVHERYSSPTAGSAKRRLFGEDPPKEMLMDKIITEGTKLKIAPSSSITAENVSILPGQTLLTMATAPVTGTTGHKVTIPLHGVANDAGEITLIPLSMNTNQESKVKSPVSLTAHSLIGASPKQTNLTKAQEVHSTGINRPKRTGSLALFYRKVYHLASVRLRDLCLKLDVSNELRRKIWTCFEFTLVHCPDLMKDRHLDQLLLCAFYIMAKVTKEERTFQEIMKSYRNQPQANSHVYRSVLLKSIPREVVAYNKNINDDFEMIDCDLEDATKTPDCSSGPVKEERGDLIKFYNTIYVGRVKSFALKYDLANQDHMMDAPPLSPFPHIKQQPGSPRRISQQHSIYISPHKNGSGLTPRSALLYKFNGSPSKVR

SEQ ID NO: 72903 - protein, 1068 aa, Homo sapiens
  Payload ID: 14440
  Gene Symbol: RBL1
  Gene Name: retinoblastoma-like 1
  Uniprot ID: P28749
  ENSP ID: ENSP00000362768
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLSLIQFFSKMKKWMDMSNLPQEFRERIERLERNFEVSTVIFKKYEPIFLDIFQNPYEEPPKLPRSRKQRRIPCSVKDLFNFCWTLFVYTKGNFRMIGDDLVNSYHLLLCCLDLIFANAIMCPNRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQPGSHIDFAVNRLKLAEILYYKILETVMVQETRRLHGMDMSVLLEQDIFHRSLMACCLEIVLFAYSSPRTFPWIIEVLNLQPFYFYKVIEVVIRSEEGLSRDMVKHLNSIEEQILESLAWSHDSALWEALQVSANKVPTCEEVIFPNNFETGNGGNVQGHLPLMPMSPLMHPRVKEVRTDSGSLRRDMQPLSPISVHERYSSPTAGSAKRRLFGEDPPKEMLMDKIITEGTKLKIAPSSSITAENVSILPGQTLLTMATAPVTGTTGHKVTIPLHGVANDAGEITLIPLSMNTNQESKVKSPVSLTAHSLIGASPKQTNLTKAQEVHSTGINRPKRTGSLALFYRKVYHLASVRLRDLCLKLDVSNELRRKIWTCFEFTLVHCPDLMKDRHLDQLLLCAFYIMAKVTKEERTFQEIMKSYRNQPQANSHVYRSVLLKSIPREVVAYNKNINDDFEMIDCDLEDATKTPDCSSGPVKEERGDLIKFYNTIYVGRVKSFALKYDLANQDHMMDAPPLSPFPHIKQQPGSPRRISQQHSIYISPHKNGSGLTPRSALLYKFNGSPSKSLKDINNMIRQGEQRTKKRVIAIDSDAESPAKRVCQENDDVLLKRLQDVVSERANH

SEQ ID NO: 72904 - protein, 254 aa, Homo sapiens
  Payload ID: 14440
  Gene Symbol: RBL1
  Gene Name: retinoblastoma-like 1
  ENSP ID: ENSP00000434711
  MOD_RES (1)..(1): Any amino acid
XIFLDIFQNPYEEPPKLPRSRKQRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQ

SEQ ID NO: 72905 - protein, 113 aa, Homo sapiens
  Payload ID: 14440
  Gene Symbol: RBL1
  Gene Name: retinoblastoma-like 1
  ENSP ID: ENSP00000437240
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLRGCCCPMSPGQLTFWQP

SEQ ID NO: 72906 - protein, 1139 aa, Homo sapiens
  Payload ID: 14441
  Gene Symbol: RBL2
  Gene Name: retinoblastoma-like 2
  Uniprot ID: Q08999
  ENSP ID: ENSP00000262133
MPSGGDQSPPPPPPPPAAAASDEEEEDDGEAEDAAPPAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 72907 - protein, 639 aa, Homo sapiens
  Payload ID: 14441
  Gene Symbol: RBL2
  Gene Name: retinoblastoma-like 2
  ENSP ID: ENSP00000443744
MQSLTKGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVS

SEQ ID NO: 72908 - protein, 849 aa, Homo sapiens
  Payload ID: 14441
  Gene Symbol: RBL2
  Gene Name: retinoblastoma-like 2
  ENSP ID: ENSP00000444685
MESRCVAQAGMQWHDLGSLQPLPPRFKRFFCLSLLSSCEYSKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 72909 - protein, 128 aa, Homo sapiens
  Payload ID: 14441
  Gene Symbol: RBL2
  Gene Name: retinoblastoma-like 2
  ENSP ID: ENSP00000462464
MKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSE

SEQ ID NO: 72910 - protein, 263 aa, Homo sapiens
  Payload ID: 14442
  Gene Symbol: RAET1E
  Gene Name: retinoic acid early transcript 1E
  Uniprot ID: Q8TD07
  ENSP ID: ENSP00000349709
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGEWQAGLWPLRTS

SEQ ID NO: 72911 - protein, 227 aa, Homo sapiens
  Payload ID: 14442
  Gene Symbol: RAET1E
  Gene Name: retinoic acid early transcript 1E
  Uniprot ID: Q8TD07
  ENSP ID: ENSP00000356332
MRRISLTSSPVRLLLFLLLLLIALEIMYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGEWQAGLWPLRTS

SEQ ID NO: 72912 - protein, 117 aa, Homo sapiens
  Payload ID: 14442
  Gene Symbol: RAET1E
  Gene Name: retinoic acid early transcript 1E
  ENSP ID: ENSP00000376096
MRRISLTSSPVRLLLFLLLLLIALEIMVGGHSLCFNFTIKSLSRPGQPWCEAQVFLNKNLFLQYNSDNNMVKPLGLLGKKILPLCKSRCFVNVKQNGALVHPGSSPPMERNPSSLTQ

SEQ ID NO: 72913 - protein, 209 aa, Homo sapiens
  Payload ID: 14442
  Gene Symbol: RAET1E
  Gene Name: retinoic acid early transcript 1E
  Uniprot ID: Q8TD07
  ENSP ID: ENSP00000432366
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTGN

SEQ ID NO: 72914 - protein, 80 aa, Homo sapiens
  Payload ID: 14442
  Gene Symbol: RAET1E
  Gene Name: retinoic acid early transcript 1E
  ENSP ID: ENSP00000433489
MRRISLTSSPVRLLLFLLLLLIALEIMVGGHSLCFNFTIKSLSRPGQPWCEAQVFLNKNLFLQYNSDNNMVKPLGLLGKK

SEQ ID NO: 72915 - protein, 212 aa, Homo sapiens
  Payload ID: 14442
  Gene Symbol: RAET1E
  Gene Name: retinoic acid early transcript 1E
  Uniprot ID: Q8TD07
  ENSP ID: ENSP00000437067
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTGRRST

SEQ ID NO: 72916 - protein, 334 aa, Homo sapiens
  Payload ID: 14443
  Gene Symbol: RAET1G
  Gene Name: retinoic acid early transcript 1G
  Uniprot ID: Q6H3X3
  ENSP ID: ENSP00000356329
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGAPPTMSSGTAQPRATATTLILCCLLIMCLLICSRHSLTQSHGHHPQSLQPPPHPPLLHPTWLLRRVLWSDSYQIAKRPLSGGHVTRVTLPIIGDDSHSLPCPLALYTINNGAARYSEPLQVSIS

SEQ ID NO: 72917 - protein, 213 aa, Homo sapiens
  Payload ID: 14443
  Gene Symbol: RAET1G
  Gene Name: retinoic acid early transcript 1G
  Uniprot ID: Q6H3X3
  ENSP ID: ENSP00000356330
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGGTV

SEQ ID NO: 72918 - protein, 221 aa, Homo sapiens
  Payload ID: 14443
  Gene Symbol: RAET1G
  Gene Name: retinoic acid early transcript 1G
  ENSP ID: ENSP00000417503
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGGNRRKRNGDLQ

SEQ ID NO: 72919 - protein, 246 aa, Homo sapiens
  Payload ID: 14444
  Gene Symbol: RAET1L
  Gene Name: retinoic acid early transcript 1L
  Uniprot ID: Q5VY80
  ENSP ID: ENSP00000286380
MAAAAIPALLLCLPLLFLLFGWSRARRDDPHSLCYDITVIPKFRPGPRWCAVQGQVDEKTFLHYDCGNKTVTPVSPLGKKLNVTMAWKAQNPVLREVVDILTEQLLDIQLENYTPKEPLTLQARMSCEQKAEGHSSGSWQFSIDGQTFLLFDSEKRMWTTVHPGARKMKEKWENDKDVAMSFHYISMGDCIGWLEDFLMGMDSTLEPSAGAPLAMSSGTTQLRATATTLILCCLLIILPCFILPGI

SEQ ID NO: 72920 - protein, 246 aa, Homo sapiens; identical to SEQ ID NO: 72919
  Payload ID: 14444
  Gene Symbol: RAET1L
  Gene Name: retinoic acid early transcript 1L
  Uniprot ID: Q5VY80
  ENSP ID: ENSP00000356310

SEQ ID NO: 72921 - protein, 1906 aa, Homo sapiens
  Payload ID: 14445
  Gene Symbol: RAI1
  Gene Name: retinoic acid induced 1
  Uniprot ID: Q7Z5J4
  ENSP ID: ENSP00000323074
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNSKKLSSTDCFKTEAFTSPEALQPGGTALAPKKRSRKGRAGAHGLSKGPLEKRPYLGPALLLTPRDRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFVRVEKRDAFTTICTVVNSPGDAPKPHRKPSSSASSSSSSSSFSLDAAGASLATLPGGSILQPRPSLPLSSTMHLGPVVSKALSTSCLVCCLCQNPANFKDLGDLCGPYYPEHCLPKKKPKLKEKVRPEGTCEEASLPLERTLKGPECAAAATAGKPPRPDGPADPAKQGPLRTSARGLSRRLQSCYCCDGREDGGEEAAPADKGRKHECSKEAPAEPGGEAQEHWVHEACAVWTGGVYLVAGKLFGLQEAMKVAVDMMCSSCQEAGATIGCCHKGCLHTYHYPCASDAGCIFIEENFSLKCPKHKRLP

SEQ ID NO: 72922 - protein, 942 aa, Homo sapiens
  Payload ID: 14445
  Gene Symbol: RAI1
  Gene Name: retinoic acid induced 1
  ENSP ID: ENSP00000379120
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWF

SEQ ID NO: 72923 - protein, 65 aa, Homo sapiens
  Payload ID: 14445
  Gene Symbol: RAI1
  Gene Name: retinoic acid induced 1
  ENSP ID: ENSP00000463607
MQSFRERCGFHGKQQNYQQTSQETSRLENYRQPSQAGLSCDRQRLLAKDYYNPQPYPSYEGGAGT

SEQ ID NO: 72924 - protein, 156 aa, Homo sapiens
  Payload ID: 14445
  Gene Symbol: RAI1
  Gene Name: retinoic acid induced 1
  ENSP ID: ENSP00000463984
  MOD_RES (1)..(1): Any amino acid
XAEPGGEAQEHWVHEACAVWTGGVYLVAGKLFGLQEAMKVAVDMMCSSCQEAGATIGCCHKGCLHTYHYPCASDAGTSPPRNRRALEPIQAVQGDPPWAQLPKPRPHLTLQFPSSLAPAILLSFCLPRPLLGNARDMEMRHSPGTCLRSAQSSEGR

SEQ ID NO: 72925 - protein, 980 aa, Homo sapiens
  Payload ID: 14446
  Gene Symbol: RAI14
  Gene Name: retinoic acid induced 14
  Uniprot ID: Q9P0K7
  ENSP ID: ENSP00000265109
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 72926 - protein, 980 aa, Homo sapiens; identical to SEQ ID NO: 72925
  Payload ID: 14446
  Gene Symbol: RAI14
  Gene Name: retinoic acid induced 14
  Uniprot ID: Q9P0K7
  ENSP ID: ENSP00000388725

SEQ ID NO: 72927 - protein, 126 aa, Homo sapiens
  Payload ID: 14446
  Gene Symbol: RAI14
  Gene Name: retinoic acid induced 14
  ENSP ID: ENSP00000421424
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYA

SEQ ID NO: 72928 - protein, 126 aa, Homo sapiens; identical to SEQ ID NO: 72927
  Payload ID: 14446
  Gene Symbol: RAI14
  Gene Name: retinoic acid induced 14
  ENSP ID: ENSP00000422112

SEQ ID NO: 72929 - protein, 107 aa, Homo sapiens
  Payload ID: 14446
  Gene Symbol: RAI14
  Gene Name: retinoic acid induced 14
  ENSP ID: ENSP00000422114
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQ

SEQ ID NO: 72930 - protein, 951 aa, Homo sapiens
  Payload ID: 14446
  Gene Symbol: RAI14
  Gene Name: retinoic acid induced 14
  Uniprot ID: Q9P0K7
  ENSP ID: ENSP00000422377
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 72931 - protein, 114 aa, Homo sapiens
  Payload ID: 14446
  Gene Symbol: RAI14
  Gene Name: retinoic acid induced 14
  ENSP ID: ENSP00000422515
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAES

SEQ ID NO: 72932 - protein, 980 aa, Homo sapiens; identical to SEQ ID NO: 72925
  Payload ID: 14446
  Gene Symbol: RAI14
  Gene Name: retinoic acid induced 14
  Uniprot ID: Q9P0K7
  ENSP ID: ENSP00000422942

SEQ ID NO: 72933 - protein, 972 aa, Homo sapiens
  Payload ID: 14446
  Gene Symbol: RAI14
  Gene Name: retinoic acid induced 14
  Uniprot ID: Q9P0K7
  ENSP ID: ENSP00000423854
MEAKTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 72934 - protein, 66 aa, Homo sapiens
  Payload ID: 14446
  Gene Symbol: RAI14
  Gene Name: retinoic acid induced 14
  ENSP ID: ENSP00000423965
MKSLKAKFRKSDTNEWNKNDDRLLQAVENGDAEKVASLLGKKGASATKHDISILLLQKDTWNASGS

SEQ ID NO: 72935 - protein, 104 aa, Homo sapiens
  Payload ID: 14446
  Gene Symbol: RAI14
  Gene Name: retinoic acid induced 14
  ENSP ID: ENSP00000424502
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRK

SEQ ID NO: 72936 - protein, 56 aa, Homo sapiens
  Payload ID: 14446
  Gene Symbol: RAI14
  Gene Name: retinoic acid induced 14
  ENSP ID: ENSP00000424507
MKSLKAKFRKSDTNEWNKNDDRLLQAVENGDAEKVASLLGKKGASATKHDSEGKTA

SEQ ID NO: 72937 - protein, 139 aa, Homo sapiens
  Payload ID: 14446
  Gene Symbol: RAI14
  Gene Name: retinoic acid induced 14
  ENSP ID: ENSP00000424879
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILC

SEQ ID NO: 72938 - protein, 150 aa, Homo sapiens
  Payload ID: 14446
  Gene Symbol: RAI14
  Gene Name: retinoic acid induced 14
  ENSP ID: ENSP00000425115
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDL

SEQ ID NO: 72939 - protein, 20 aa, Homo sapiens
  Payload ID: 14446
  Gene Symbol: RAI14
  Gene Name: retinoic acid induced 14
  ENSP ID: ENSP00000425337
MKSLKAKFRKSDEFEICKEL

SEQ ID NO: 72940 - protein, 56 aa, Homo sapiens; identical to SEQ ID NO: 72936
  Payload ID: 14446
  Gene Symbol: RAI14
  Gene Name: retinoic acid induced 14
  ENSP ID: ENSP00000425929

SEQ ID NO: 72941 - protein, 125 aa, Homo sapiens
  Payload ID: 14446
  Gene Symbol: RAI14
  Gene Name: retinoic acid induced 14
  ENSP ID: ENSP00000426770
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHY

SEQ ID NO: 72942 - protein, 983 aa, Homo sapiens
  Payload ID: 14446
  Gene Symbol: RAI14
  Gene Name: retinoic acid induced 14
  Uniprot ID: Q9P0K7
  ENSP ID: ENSP00000427123
MQPTYLPWLSAKEKKTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 72943 - protein, 530 aa, Homo sapiens
  Payload ID: 14447
  Gene Symbol: RAI2
  Gene Name: retinoic acid induced 2
  Uniprot ID: Q9Y5P3
  ENSP ID: ENSP00000333456
MDDLQSQNLSMDMTDSPPALANNRLENGMAQLITTEAWNINSTDLVKKALVTVPAPSILNPPAESQSGMALKVAATVLQPLCLGESPVVMPIHMQVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPMPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 72944 - protein, 530 aa, Homo sapiens; identical to SEQ ID NO: 72943
  Payload ID: 14447
  Gene Symbol: RAI2
  Gene Name: retinoic acid induced 2
  Uniprot ID: Q9Y5P3
  ENSP ID: ENSP00000353106

SEQ ID NO: 72945 - protein, 480 aa, Homo sapiens
  Payload ID: 14447
  Gene Symbol: RAI2
  Gene Name: retinoic acid induced 2
  Uniprot ID: Q9Y5P3
  ENSP ID: ENSP00000392578
MDDLQSQNLSMDMTDSPPALANNRLENGMAQLITTEAWNINSTDLVEGSSAPELNPNGNATYVMTTQGPVQLPVVLEQHVFQHLNSPLVLPQEAPCSSSTIHNNLFQGAEDPEAQPQLLDLRIPSQPQEPTLPFEAVLQNLFPSQGTLGPPPCQPPPGYAPVPPQPFSSPLSPLVPPATLLVPYPVIVPLPVPVPIPIPIPMPQSSESKFSSSFPKPPSSFGLHPFKGTQTPLEKDELKPFDILQPKEYFQLSRHTVIKMGSENEALDLSMKSVPWLKAGEVSPPIFQEDAALDLSVAAHRKSEPPPETLYDSGASVDSSGHTVMEKLPSGMEISFAPATSHEAPAMMDSHISSSDAATEMLSQPNHPSGEVKAENNIEMVGESQAAKVIVSVEDAVPTIFCGKIKGLSGVSTKNFSFKREDSVLQGYDINSQGEESMGNAEPLRKPIKNRSIKLKKVNSQEIHMLPIKKQRLATFFPRK

SEQ ID NO: 72946 - protein, 530 aa, Homo sapiens; identical to SEQ ID NO: 72943
  Payload ID: 14447
  Gene Symbol: RAI2
  Gene Name: retinoic acid induced 2
  Uniprot ID: Q9Y5P3
  ENSP ID: ENSP00000401323

SEQ ID NO: 72947 - protein, 530 aa, Homo sapiens; identical to SEQ ID NO: 72943
  Payload ID: 14447
  Gene Symbol: RAI2
  Gene Name: retinoic acid induced 2
  Uniprot ID: Q9Y5P3
  ENSP ID: ENSP00000444210

SEQ ID NO: 72948 - protein, 81 aa, Homo sapiens
  Payload ID: 14447
  Gene Symbol: RAI2
  Gene Name: retinoic acid induced 2
  ENSP ID: ENSP00000473562
MDDLQSQNLSMDMTDSPPALANNRLENGMAQLITTEAWNINSTDLPLCLGESPVVMPIHMQVEGSSAPELNPNGNATYVMT

SEQ ID NO: 72949 - protein, 294 aa, Homo sapiens
  Payload ID: 14448
  Gene Symbol: RARRES1
  Gene Name: retinoic acid receptor responder (tazarotene induced) 1
  Uniprot ID: P49788
  ENSP ID: ENSP00000237696
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 72950 - protein, 228 aa, Homo sapiens
  Payload ID: 14448
  Gene Symbol: RARRES1
  Gene Name: retinoic acid receptor responder (tazarotene induced) 1
  Uniprot ID: P49788
  ENSP ID: ENSP00000418556
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWVRKT

SEQ ID NO: 72951 - protein, 163 aa, Homo sapiens
  Payload ID: 14449
  Gene Symbol: RARRES2
  Gene Name: retinoic acid receptor responder (tazarotene induced) 2
  Uniprot ID: Q99969
  ENSP ID: ENSP00000223271
MRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLREAEEHQETQCLRVQRAGEDPHSFYFPGQFAFSKALPRS

SEQ ID NO: 72952 - protein, 159 aa, Homo sapiens
  Payload ID: 14449
  Gene Symbol: RARRES2
  Gene Name: retinoic acid receptor responder (tazarotene induced) 2
  ENSP ID: ENSP00000417669
MRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLRRCVVPPGPLRVVTSGRPQPPGRGTRSIPSHDNKA

SEQ ID NO: 72953 - protein, 163 aa, Homo sapiens; identical to SEQ ID NO: 72951
  Payload ID: 14449
  Gene Symbol: RARRES2
  Gene Name: retinoic acid receptor responder (tazarotene induced) 2
  Uniprot ID: Q99969
  ENSP ID: ENSP00000418009

SEQ ID NO: 72954 - protein, 163 aa, Homo sapiens; identical to SEQ ID NO: 72951
  Payload ID: 14449
  Gene Symbol: RARRES2
  Gene Name: retinoic acid receptor responder (tazarotene induced) 2
  Uniprot ID: Q99969
  ENSP ID: ENSP00000418483

SEQ ID NO: 72955 - protein, 164 aa, Homo sapiens
  Payload ID: 14450
  Gene Symbol: RARRES3
  Gene Name: retinoic acid receptor responder (tazarotene induced) 3
  Uniprot ID: Q9UL19
  ENSP ID: ENSP00000255688
MASPHQEPKPGDLIEIFRLGYEHWALYIGDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFAIRRYQKKATA

SEQ ID NO: 72956 - protein, 164 aa, Homo sapiens
  Payload ID: 14450
  Gene Symbol: RARRES3
  Gene Name: retinoic acid receptor responder (tazarotene induced) 3
  ENSP ID: ENSP00000346431
MGLPEPKPKPGDLIEIFRLGYEHWALYIGDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFAIRRYQKKATA

SEQ ID NO: 72957 - protein, 156 aa, Homo sapiens
  Payload ID: 14450
  Gene Symbol: RARRES3
  Gene Name: retinoic acid receptor responder (tazarotene induced) 3
  Uniprot ID: Q9UL19
  ENSP ID: ENSP00000402943
MASPHQEPKPGDLIEIFRLGYEHWALYIGDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVRTSLDNPSPSAWGWTHGAVQPGDHCE

SEQ ID NO: 72958 - protein, 462 aa, Homo sapiens
  Payload ID: 14451
  Gene Symbol: RARA
  Gene Name: retinoic acid receptor, alpha
  Uniprot ID: P10276
  ENSP ID: ENSP00000254066
MASNSSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 72959 - protein, 457 aa, Homo sapiens
  Payload ID: 14451
  Gene Symbol: RARA
  Gene Name: retinoic acid receptor, alpha
  Uniprot ID: P10276
  ENSP ID: ENSP00000377643
MYESVEVGGPTPNPFLVVDFYNQNRACLLPEKGLPAPGPYSTPLRTPLWNGSNHSIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 72960 - protein, 478 aa, Homo sapiens
  Payload ID: 14451
  Gene Symbol: RARA
  Gene Name: retinoic acid receptor, alpha
  ENSP ID: ENSP00000377648
MMSQTMTQAGVSFRHSVRAAQCHTRVPNTWPRATRPYASCRRSPRLRGRWPGSAGQGAGGRAPRAGWRAGDVTGSAIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 72961 - protein, 462 aa, Homo sapiens; identical to SEQ ID NO: 72958
  Payload ID: 14451
  Gene Symbol: RARA
  Gene Name: retinoic acid receptor, alpha
  Uniprot ID: P10276
  ENSP ID: ENSP00000377649

SEQ ID NO: 72962 - protein, 365 aa, Homo sapiens
  Payload ID: 14451
  Gene Symbol: RARA
  Gene Name: retinoic acid receptor, alpha
  Uniprot ID: P10276
  ENSP ID: ENSP00000389993
MASNSSSCPTPGGGHLNGYPVPPYAFFFPPMLGGLSPPGALTTLQHQLPVSGYSTPSPATVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 72963 - protein, 186 aa, Homo sapiens
  Payload ID: 14451
  Gene Symbol: RARA
  Gene Name: retinoic acid receptor, alpha
  ENSP ID: ENSP00000462514
MVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPL

SEQ ID NO: 72964 - protein, 66 aa, Homo sapiens
  Payload ID: 14451
  Gene Symbol: RARA
  Gene Name: retinoic acid receptor, alpha
  ENSP ID: ENSP00000464287
MASNSSSCPTPGGGHLNGYPVPPYAFFFPPMLGGLSPPGALTTLQHQLPVSGYSTPSPATIETQSS

SEQ ID NO: 72965 - protein, 448 aa, Homo sapiens
  Payload ID: 14452
  Gene Symbol: RARB
  Gene Name: retinoic acid receptor, beta
  Uniprot ID: P10826
  ENSP ID: ENSP00000332296
MFDCMDVLSVSPGQILDFYTASPSSCMLQEKALKACFSGLTQTEWQHRHTAQSIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 72966 - protein, 402 aa, Homo sapiens
  Payload ID: 14452
  Gene Symbol: RARB
  Gene Name: retinoic acid receptor, beta
  ENSP ID: ENSP00000373282
MTTSGHACPVPAVNGHMTHYPATPYPLLFPPVIGGLSLPPLHGLHGHPPPSGCSTPSPATIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEI

SEQ ID NO: 72967 - protein, 336 aa, Homo sapiens
  Payload ID: 14452
  Gene Symbol: RARB
  Gene Name: retinoic acid receptor, beta
  Uniprot ID: P10826
  ENSP ID: ENSP00000391391
MIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 72968 - protein, 336 aa, Homo sapiens; identical to SEQ ID NO: 72967
  Payload ID: 14452
  Gene Symbol: RARB
  Gene Name: retinoic acid receptor, beta
  Uniprot ID: P10826
  ENSP ID: ENSP00000398840

SEQ ID NO: 72969 - protein, 443 aa, Homo sapiens
  Payload ID: 14453
  Gene Symbol: RARG
  Gene Name: retinoic acid receptor, gamma
  Uniprot ID: P13631
  ENSP ID: ENSP00000343698
MYDCMETFAPGPRRLYGAAGPGAGLLRRATGGSCFAGLESFAWPQPASLQSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 72970 - protein, 382 aa, Homo sapiens
  Payload ID: 14453
  Gene Symbol: RARG
  Gene Name: retinoic acid receptor, gamma
  Uniprot ID: P13631
  ENSP ID: ENSP00000377947
MVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 72971 - protein, 454 aa, Homo sapiens
  Payload ID: 14453
  Gene Symbol: RARG
  Gene Name: retinoic acid receptor, gamma
  Uniprot ID: P13631
  ENSP ID: ENSP00000388510
MATNKERLFAAGALGPGSGYPGAGFPFAFPGALRGSPPFEMLSPSFRGLGQPDLPKEMASLSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 72972 - protein, 432 aa, Homo sapiens
  Payload ID: 14453
  Gene Symbol: RARG
  Gene Name: retinoic acid receptor, gamma
  Uniprot ID: P13631
  ENSP ID: ENSP00000444335
MLALPLPPCWSGAPPGEEGESAAGPWCFQHPVSLQAGSRCTTVWKRLPRVRDGCTGRPGPGPACCAEPPAAPVSPDLNLLPGRNPPACNGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 72973 - protein, 15 aa, Homo sapiens
  Payload ID: 14453
  Gene Symbol: RARG
  Gene Name: retinoic acid receptor, gamma
  ENSP ID: ENSP00000454385
MATNKERLFAAGALG

SEQ ID NO: 72974 - protein, 57 aa, Homo sapiens
  Payload ID: 14453
  Gene Symbol: RARG
  Gene Name: retinoic acid receptor, gamma
  ENSP ID: ENSP00000454417
MATNKERLFAAGALGPGSGYPGAGFPFAFPGALRGSPPFEMLSPSFRGLGQPDLPKE

SEQ ID NO: 72975 - protein, 32 aa, Homo sapiens
  Payload ID: 14453
  Gene Symbol: RARG
  Gene Name: retinoic acid receptor, gamma
  ENSP ID: ENSP00000454604
MATNKERLFAAGALGPGSGYPGAGFPFAFPGA

SEQ ID NO: 72976 - protein, 462 aa, Homo sapiens
  Payload ID: 14454
  Gene Symbol: RXRA
  Gene Name: retinoid X receptor, alpha
  Uniprot ID: P19793
  ENSP ID: ENSP00000419692
MDTKHFLPLDFSTQVNSSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 72977 - protein, 533 aa, Homo sapiens
  Payload ID: 14455
  Gene Symbol: RXRB
  Gene Name: retinoid X receptor, beta
  Uniprot ID: P28702
  ENSP ID: ENSP00000363812
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 72978 - protein, 537 aa, Homo sapiens
  Payload ID: 14455
  Gene Symbol: RXRB
  Gene Name: retinoid X receptor, beta
  Uniprot ID: P28702
  ENSP ID: ENSP00000363817
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRSLSRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 72979 - protein, 537 aa, Homo sapiens; identical to SEQ ID NO: 72978
  Payload ID: 14455
  Gene Symbol: RXRB
  Gene Name: retinoid X receptor, beta
  Uniprot ID: P28702
  ENSP ID: ENSP00000372703

SEQ ID NO: 72980 - protein, 533 aa, Homo sapiens; identical to SEQ ID NO: 72977
  Payload ID: 14455
  Gene Symbol: RXRB
  Gene Name: retinoid X receptor, beta
  Uniprot ID: P28702
  ENSP ID: ENSP00000372704

SEQ ID NO: 72981 - protein, 96 aa, Homo sapiens
  Payload ID: 14455
  Gene Symbol: RXRB
  Gene Name: retinoid X receptor, beta
  ENSP ID: ENSP00000389514
  MOD_RES (1)..(1): Any amino acid
XSPNDPVTNICQAADKQLFTLVEWAKRIPHFSSLPLDDQVILLRAGLHVHRNSAHSAGVGAIFDRVLTELVSKMRDMRMDKTELGCLRAIILFNPD

SEQ ID NO: 72982 - protein, 96 aa, Homo sapiens; identical to SEQ ID NO: 72981
  Payload ID: 14455
  Gene Symbol: RXRB
  Gene Name: retinoid X receptor, beta
  ENSP ID: ENSP00000392937
  MOD_RES (1)..(1): Any amino acid

SEQ ID NO: 72983 - protein, 537 aa, Homo sapiens; identical to SEQ ID NO: 72978
  Payload ID: 14455
  Gene Symbol: RXRB
  Gene Name: retinoid X receptor, beta
  Uniprot ID: P28702
  ENSP ID: ENSP00000393286

SEQ ID NO: 72984 - protein, 537 aa, Homo sapiens; identical to SEQ ID NO: 72978
  Payload ID: 14455
  Gene Symbol: RXRB
  Gene Name: retinoid X receptor, beta
  Uniprot ID: P28702
  ENSP ID: ENSP00000393870

SEQ ID NO: 72985 - protein, 537 aa, Homo sapiens; identical to SEQ ID NO: 72978
  Payload ID: 14455
  Gene Symbol: RXRB
  Gene Name: retinoid X receptor, beta
  Uniprot ID: P28702
  ENSP ID: ENSP00000400104

SEQ ID NO: 72986 - protein, 533 aa, Homo sapiens; identical to SEQ ID NO: 72977
  Payload ID: 14455
  Gene Symbol: RXRB
  Gene Name: retinoid X receptor, beta
  Uniprot ID: P28702
  ENSP ID: ENSP00000402506

SEQ ID NO: 72987 - protein, 537 aa, Homo sapiens; identical to SEQ ID NO: 72978
  Payload ID: 14455
  Gene Symbol: RXRB
  Gene Name: retinoid X receptor, beta
  Uniprot ID: P28702
  ENSP ID: ENSP00000402590

SEQ ID NO: 72988 - protein, 96 aa, Homo sapiens; identical to SEQ ID NO: 72981
  Payload ID: 14455
  Gene Symbol: RXRB
  Gene Name: retinoid X receptor, beta
  ENSP ID: ENSP00000406246
  MOD_RES (1)..(1): Any amino acid

SEQ ID NO: 72989 - protein, 96 aa, Homo sapiens; identical to SEQ ID NO: 72981
  Payload ID: 14455
  Gene Symbol: RXRB
  Gene Name: retinoid X receptor, beta
  ENSP ID: ENSP00000410433
  MOD_RES (1)..(1): Any amino acid

SEQ ID NO: 72990 - protein, 533 aa, Homo sapiens; identical to SEQ ID NO: 72977
  Payload ID: 14455
  Gene Symbol: RXRB
  Gene Name: retinoid X receptor, beta
  Uniprot ID: P28702
  ENSP ID: ENSP00000410468

SEQ ID NO: 72991 - protein, 533 aa, Homo sapiens; identical to SEQ ID NO: 72977
  Payload ID: 14455
  Gene Symbol: RXRB
  Gene Name: retinoid X receptor, beta
  Uniprot ID: P28702
  ENSP ID: ENSP00000411238

SEQ ID NO: 72992 - protein, 96 aa, Homo sapiens; identical to SEQ ID NO: 72981
  Payload ID: 14455
  Gene Symbol: RXRB
  Gene Name: retinoid X receptor, beta
  ENSP ID: ENSP00000411729
  MOD_RES (1)..(1): Any amino acid

SEQ ID NO: 72993 - protein, 533 aa, Homo sapiens; identical to SEQ ID NO: 72977
  Payload ID: 14455
  Gene Symbol: RXRB
  Gene Name: retinoid X receptor, beta
  Uniprot ID: P28702
  ENSP ID: ENSP00000415199

SEQ ID NO: 72994 - protein, 79 aa, Homo sapiens
  Payload ID: 14455
  Gene Symbol: RXRB
  Gene Name: retinoid X receptor, beta
  ENSP ID: ENSP00000431353
MSWAARPPFLPQRHAAGQCGPVGVRKEMHCGVASRWRRRRPWLDPAAAAAAAVAGGEQQTPEPEPGEAGRDGMGDSGRD

SEQ ID NO: 72995 - protein, 79 aa, Homo sapiens; identical to SEQ ID NO: 72994
  Payload ID: 14455
  Gene Symbol: RXRB
  Gene Name: retinoid X receptor, beta
  ENSP ID: ENSP00000431369

SEQ ID NO: 72996 - protein, 79 aa, Homo sapiens; identical to SEQ ID NO: 72994
  Payload ID: 14455
  Gene Symbol: RXRB
  Gene Name: retinoid X receptor, beta
  ENSP ID: ENSP00000432690

SEQ ID NO: 72997 - protein, 79 aa, Homo sapiens; identical to SEQ ID NO: 72994
  Payload ID: 14455
  Gene Symbol: RXRB
  Gene Name: retinoid X receptor, beta
  ENSP ID: ENSP00000433265

SEQ ID NO: 72998 - protein, 79 aa, Homo sapiens; identical to SEQ ID NO: 72994
  Payload ID: 14455
  Gene Symbol: RXRB
  Gene Name: retinoid X receptor, beta
  ENSP ID: ENSP00000434208

SEQ ID NO: 72999 - protein, 347 aa, Homo sapiens
  Payload ID: 14455
  Gene Symbol: RXRB
  Gene Name: retinoid X receptor, beta
  ENSP ID: ENSP00000435434
MRECGGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRSLSRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 73000 - protein, 79 aa, Homo sapiens; identical to SEQ ID NO: 72994
  Payload ID: 14455
  Gene Symbol: RXRB
  Gene Name: retinoid X receptor, beta
  ENSP ID: ENSP00000435471

SEQ ID NO: 73001 - protein, 463 aa, Homo sapiens
  Payload ID: 14456
  Gene Symbol: RXRG
  Gene Name: retinoid X receptor, gamma
  Uniprot ID: P48443
  ENSP ID: ENSP00000352900
MYGNYSHFMKFPAGYGGSPGHTGSTSMSPSAALSTGKPMDSHPSYTDTPVSAPRTLSAVGTPLNALGSPYRVITSAMGPPSGALAAPPGINLVAPPSSQLNVVNSVSSSEDIKPLPGLPGIGNMNYPSTSPGSLVKHICAICGDRSSGKHYGVYSCEGCKGFFKRTIRKDLIYTCRDNKDCLIDKRQRNRCQYCRYQKCLVMGMKREAVQEERQRSRERAESEAECATSGHEDMPVERILEAELAVEPKTESYGDMNMENSTNDPVTNICHAADKQLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVLFNPDAKGLSNPSEVETLREKVYATLEAYTKQKYPEQPGRFAKLLLRLPALRSIGLKCLEHLFFFKLIGDTPIDTFLMEMLETPLQIT

SEQ ID NO: 73002 - protein, 340 aa, Homo sapiens
  Payload ID: 14456
  Gene Symbol: RXRG
  Gene Name: retinoid X receptor, gamma
  ENSP ID: ENSP00000482458
MNYPSTSPGSLVKHICAICGDRSSGKHYGVYSCEGCKGFFKRTIRKDLIYTCRDNKDCLIDKRQRNRCQYCRYQKCLVMGMKREAVQEERQRSRERAESEAECATSGHEDMPVERILEAELAVEPKTESYGDMNMENSTNDPVTNICHAADKQLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVLFNPDAKGLSNPSEVETLREKVYATLEAYTKQKYPEQPGRFAKLLLRLPALRSIGLKCLEHLFFFKLIGDTPIDTFLMEMLETPLQIT

SEQ ID NO: 73003 - protein, 197 aa, Homo sapiens
  Payload ID: 14457
  Gene Symbol: RBP1
  Gene Name: retinol binding protein 1, cellular
  ENSP ID: ENSP00000232219
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMTTVSWDGDKLQCVQKGEKEGRGWTQWIEGDELHLEMRVEGVVCKQVFKKVQ

SEQ ID NO: 73004 - protein, 91 aa, Homo sapiens
  Payload ID: 14457
  Gene Symbol: RBP1
  Gene Name: retinol binding protein 1, cellular
  ENSP ID: ENSP00000424813
MPVDFTGYWKMLVNENFEEYLRALDVNVALRKIANLLKPDKEIVQDGDHMIIRTLSTFRNYIMDFQVGKEFEEDLTGIDDRKCMSETGFSS

SEQ ID NO: 73005 - protein, 98 aa, Homo sapiens
  Payload ID: 14457
  Gene Symbol: RBP1
  Gene Name: retinol binding protein 1, cellular
  ENSP ID: ENSP00000427492
MPVDFTGYWKMLVNENFEEYLRALDVNVALRKIANLLKPDKEIVQDGDHMIIRTLSTFRNYIMDFQVGKEFEEDLTGIDDRKCMVRIRVHLVSPAQGA

SEQ ID NO: 73006 - protein, 157 aa, Homo sapiens
  Payload ID: 14457
  Gene Symbol: RBP1
  Gene Name: retinol binding protein 1, cellular
  Uniprot ID: P09455
  ENSP ID: ENSP00000429166
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMAGVQSRDLSSL

SEQ ID NO: 73007 - protein, 153 aa, Homo sapiens
  Payload ID: 14457
  Gene Symbol: RBP1
  Gene Name: retinol binding protein 1, cellular
  Uniprot ID: P09455
  ENSP ID: ENSP00000477621
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMSETGFSS

SEQ ID NO: 73008 - protein, 135 aa, Homo sapiens
  Payload ID: 14457
  Gene Symbol: RBP1
  Gene Name: retinol binding protein 1, cellular
  Uniprot ID: P09455
  ENSP ID: ENSP00000482165
MPVDFTGYWKMLVNENFEEYLRALDVNVALRKIANLLKPDKEIVQDGDHMIIRTLSTFRNYIMDFQVGKEFEEDLTGIDDRKCMTTVSWDGDKLQCVQKGEKEGRGWTQWIEGDELHLEMRVEGVVCKQVFKKVQ

SEQ ID NO: 73009 - protein, 134 aa, Homo sapiens
  Payload ID: 14458
  Gene Symbol: RBP2
  Gene Name: retinol binding protein 2, cellular
  Uniprot ID: P50120
  ENSP ID: ENSP00000232217
MTRDQNGTWEMESNENFEGYMKALDIDFATRKIAVRLTQTKVIDQDGDNFKTKTTSTFRNYDVDFTVGVEFDEYTKSLDNRHVKALVTWEGDVLVCVQKGEKENRGWKQWIEGDKLYLELTCGDQVCRQVFKKK

SEQ ID NO: 73010 - protein, 24 aa, Homo sapiens
  Payload ID: 14458
  Gene Symbol: RBP2
  Gene Name: retinol binding protein 2, cellular
  ENSP ID: ENSP00000421266
MTRDQNGTWEMESNENFEGYMKAL

SEQ ID NO: 73011 - protein, 103 aa, Homo sapiens
  Payload ID: 14458
  Gene Symbol: RBP2
  Gene Name: retinol binding protein 2, cellular
  ENSP ID: ENSP00000424333
MTRDQNGTWEMESNENFEGYMKALDIDFATRKIAVRLTQTKVIDQDGDNFKTKTTSTFRNYDVDFTVGVEFDEYTKSLDNRHVKALVTWEGDVLVCVQKGEKE

SEQ ID NO: 73012 - protein, 1247 aa, Homo sapiens
  Payload ID: 14459
  Gene Symbol: RBP3
  Gene Name: retinol binding protein 3, interstitial
  Uniprot ID: P10745
  ENSP ID: ENSP00000463151
MMREWVLLMSVLLCGLAGPTHLFQPSLVLDMAKVLLDNYCFPENLLGMQEAIQQAIKSHEILSISDPQTLASVLTAGVQSSLNDPRLVISYEPSTPEPPPQVPALTSLSEEELLAWLQRGLRHEVLEGNVGYLRVDSVPGQEVLSMMGEFLVAHVWGNLMGTSALVLDLRHCTGGQVSGIPYIISYLHPGNTILHVDTIYNRPSNTTTEIWTLPQVLGERYGADKDVVVLTSSQTRGVAEDIAHILKQMRRAIVVGERTGGGALDLRKLRIGESDFFFTVPVSRSLGPLGGGSQTWEGSGVLPCVGTPAEQALEKALAILTLRSALPGVVHCLQEVLKDYYTLVDRVPTLLQHLASMDFSTVVSEEDLVTKLNAGLQAASEDPRLLVRAIGPTETPSWPAPDAAAEDSPGVAPELPEDEAIRQALVDSVFQVSVLPGNVGYLRFDSFADASVLGVLAPYVLRQVWEPLQDTEHLIMDLRHNPGGPSSAVPLLLSYFQGPEAGPVHLFTTYDRRTNITQEHFSHMELPGPRYSTQRGVYLLTSHRTATAAEEFAFLMQSLGWATLVGEITAGNLLHTRTVPLLDTPEGSLALTVPVLTFIDNHGEAWLGGGVVPDAIVLAEEALDKAQEVLEFHQSLGALVEGTGHLLEAHYARPEVVGQTSALLRAKLAQGAYRTAVDLESLASQLTADLQEVSGDHRLLVFHSPGELVVEEAPPPPPAVPSPEELTYLIEALFKTEVLPGQLGYLRFDAMAELETVKAVGPQLVRLVWQQLVDTAALVIDLRYNPGSYSTAIPLLCSYFFEAEPRQHLYSVFDRATSKVTEVWTLPQVAGQRYGSHKDLYILMSHTSGSAAEAFAHTMQDLQRATVIGEPTAGGALSVGIYQVGSSPLYASMPTQMAMSATTGKAWDLAGVEPDITVPMSEALSIAQDIVALRAKVPTVLQTAGKLVADNYASAELGAKMATKLSGLQSRYSRVTSEVALAEILGADLQMLSGDPHLKAAHIPENAKDRIPGIVPMQIPSPEVFEELIKFSFHTNVLEDNIGYLRFDMFGDGELLTQVSRLLVEHIWKKIMHTDAMIIDMRFNIGGPTSSIPILCSYFFDEGPPVLLDKIYSRPDDSVSELWTHAQVVGERYGSKKSMVILTSSVTAGTAEEFTYIMKRLGRALVIGEVTSGGCQPPQTYHVDDTNLYLTIPTARSVGASDGSSWEGVGVTPHVVVPAEEALARAKEMLQHNQLRVKRSPGLQDHL

SEQ ID NO: 73013 - protein, 201 aa, Homo sapiens
  Payload ID: 14460
  Gene Symbol: RBP4
  Gene Name: retinol binding protein 4, plasma
  Uniprot ID: P02753
  ENSP ID: ENSP00000360519
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 73014 - protein, 201 aa, Homo sapiens; identical to SEQ ID NO: 73013
  Payload ID: 14460
  Gene Symbol: RBP4
  Gene Name: retinol binding protein 4, plasma
  Uniprot ID: P02753
  ENSP ID: ENSP00000360522

SEQ ID NO: 73015 - protein, 199 aa, Homo sapiens
  Payload ID: 14460
  Gene Symbol: RBP4
  Gene Name: retinol binding protein 4, plasma
  ENSP ID: ENSP00000360524
MNYSKIPAQVDLRRQTERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 73016 - protein, 199 aa, Homo sapiens
  Payload ID: 14460
  Gene Symbol: RBP4
  Gene Name: retinol binding protein 4, plasma
  ENSP ID: ENSP00000480654
MKWVWALLLLAAWAAAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 73017 - protein, 199 aa, Homo sapiens; identical to SEQ ID NO: 73015
  Payload ID: 14460
  Gene Symbol: RBP4
  Gene Name: retinol binding protein 4, plasma
  ENSP ID: ENSP00000487033

SEQ ID NO: 73018 - protein, 135 aa, Homo sapiens
  Payload ID: 14461
  Gene Symbol: RBP5
  Gene Name: retinol binding protein 5, cellular
  Uniprot ID: P82980
  ENSP ID: ENSP00000266560
MPPNLTGYYRFVSQKNMEDYLQALNISLAVRKIALLLKPDKEIEHQGNHMTVRTLSTFRNYTVQFDVGVEFEEDLRSVDGRKCQTIVTWEEEHLVCVQKGEVPNRGWRHWLEGEMLYLELTARDAVCEQVFRKVR

SEQ ID NO: 73019 - protein, 97 aa, Homo sapiens
  Payload ID: 14461
  Gene Symbol: RBP5
  Gene Name: retinol binding protein 5, cellular
  ENSP ID: ENSP00000438083
MPPNLTGYYRFVSQKNMEDYLQALNISLAVRKIALLLKPDKEIEHQGNHMTVRTLSTFRNYTVQFDVGVEFEEDLRSVDGRKCQAALGMNSPARAIS

SEQ ID NO: 73020 - protein, 69 aa, Homo sapiens
  Payload ID: 14461
  Gene Symbol: RBP5
  Gene Name: retinol binding protein 5, cellular
  ENSP ID: ENSP00000445483
MPPNLTGYYRFVSQKNMEDYLQALSSPHRHQLGCAEDRAAAEAGQGDRTPGQPHDGEDAQHLPKLHCAV

SEQ ID NO: 73021 - protein, 134 aa, Homo sapiens
  Payload ID: 14462
  Gene Symbol: RBP7
  Gene Name: retinol binding protein 7, cellular
  Uniprot ID: Q96R05
  ENSP ID: ENSP00000294435
MPADLSGTWTLLSSDNFEGYMLALGIDFATRKIAKLLKPQKVIEQNGDSFTIHTNSSLRNYFVKFKVGEEFDEDNRGLDNRKCKSLVIWDNDRLTCIQKGEKKNRGWTHWIEGDKLHLEMFCEGQVCKQTFQRA

SEQ ID NO: 73022 - protein, 59 aa, Homo sapiens
  Payload ID: 14462
  Gene Symbol: RBP7
  Gene Name: retinol binding protein 7, cellular
  ENSP ID: ENSP00000324228
MPADLSGTWTLLSSDNFEGYMLALDGVLLLLPRLECNGGISAHRNFRLPGSNNSPASAS

SEQ ID NO: 73023 - protein, 341 aa, Homo sapiens
  Payload ID: 14463
  Gene Symbol: RDH10
  Gene Name: retinol dehydrogenase 10 (all-trans)
  Uniprot ID: Q8IZV5
  ENSP ID: ENSP00000240285
MNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELKAAEKDGIKTTLVCPYLVDTGMFRGCRIRKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 73024 - protein, 176 aa, Homo sapiens
  Payload ID: 14463
  Gene Symbol: RDH10
  Gene Name: retinol dehydrogenase 10 (all-trans)
  ENSP ID: ENSP00000428132
MMVNCHAHFWTTKAFLPTMLEINHGHIVTVASSLGLFSTAGVEDYCASKFGVVGFHESLSHELKAAEKDGIKTTLVCPYLVDTGMFRGCRIRKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 73025 - protein, 62 aa, Homo sapiens
  Payload ID: 14463
  Gene Symbol: RDH10
  Gene Name: retinol dehydrogenase 10 (all-trans)
  ENSP ID: ENSP00000429727
MMVNCHAHFWTTKAFLPTMLEINHGHIVTVASSLGLFSTAGVEDYCASKFGVVGFHESLSHE

SEQ ID NO: 73026 - protein, 318 aa, Homo sapiens
  Payload ID: 14464
  Gene Symbol: RDH11
  Gene Name: retinol dehydrogenase 11 (all-trans/9-cis/11-cis)
  Uniprot ID: Q8TC12
  ENSP ID: ENSP00000370750
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 73027 - protein, 248 aa, Homo sapiens
  Payload ID: 14464
  Gene Symbol: RDH11
  Gene Name: retinol dehydrogenase 11 (all-trans/9-cis/11-cis)
  Uniprot ID: Q8TC12
  ENSP ID: ENSP00000416395
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 73028 - protein, 186 aa, Homo sapiens
  Payload ID: 14464
  Gene Symbol: RDH11
  Gene Name: retinol dehydrogenase 11 (all-trans/9-cis/11-cis)
  ENSP ID: ENSP00000450435
MVELMFPLLLLLLPFLLYMAAPQIRKMLSSGVCTSTVQLPGKVVVVTGANTGIGKETAKELAQREEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSE

SEQ ID NO: 73029 - protein, 178 aa, Homo sapiens
  Payload ID: 14464
  Gene Symbol: RDH11
  Gene Name: retinol dehydrogenase 11 (all-trans/9-cis/11-cis)
  ENSP ID: ENSP00000450651
MVELMFPLLLLLLPFLLYMAAPQIRKMLSSGVCTSTVQLPGKVVVVTGANTGIGKETAKELAQRGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQ

SEQ ID NO: 73030 - protein, 204 aa, Homo sapiens
  Payload ID: 14464
  Gene Symbol: RDH11
  Gene Name: retinol dehydrogenase 11 (all-trans/9-cis/11-cis)
  ENSP ID: ENSP00000450802
SDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKVQSELVRHSSFMRWMWWLFSFFIKTPQQGAQTSLHCALTEGLEILSGNHFSDCHVAWVSAQARNETIARRLWDVSCDLLGLPID

SEQ ID NO: 73031 - protein, 61 aa, Homo sapiens
  Payload ID: 14464
  Gene Symbol: RDH11
  Gene Name: retinol dehydrogenase 11 (all-trans/9-cis/11-cis)
  ENSP ID: ENSP00000451280
MVELMFPLLLLLLPFLLYMAAPQIRSLPPNPSAARETKGISPIKDSKCVFPRTSPGKDPLP

SEQ ID NO: 73032 - protein, 305 aa, Homo sapiens
  Payload ID: 14464
  Gene Symbol: RDH11
  Gene Name: retinol dehydrogenase 11 (all-trans/9-cis/11-cis)
  Uniprot ID: Q8TC12
  ENSP ID: ENSP00000452079
MVELMFPLLLLLLPFLLYMAAPQIRKMLSSGVCTSTVQLPGKVVVVTGANTGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSAQARNETIARRLWDVSCDLLGLPID

SEQ ID NO: 73033 - protein, 62 aa, Homo sapiens
  Payload ID: 14464
  Gene Symbol: RDH11
  Gene Name: retinol dehydrogenase 11 (all-trans/9-cis/11-cis)
  ENSP ID: ENSP00000452108
MVELMFPLLLLLLPFLLYMAAPQIRSSSIFSLPGCGKGGIGGQRDPDHDREPAGVGAETGPV

SEQ ID NO: 73034 - protein, 316 aa, Homo sapiens
  Payload ID: 14465
  Gene Symbol: RDH12
  Gene Name: retinol dehydrogenase 12 (all-trans/9-cis/11-cis)
  Uniprot ID: Q96NR8
  ENSP ID: ENSP00000267502
MLVTLGLLTSFFSFLYMVAPSIRKFFAGGVCRTNVQLPGKVVVITGANTGIGKETARELASRGARVYIACRDVLKGESAASEIRVDTKNSQVLVRKLDLSDTKSIRAFAEGFLAEEKQLHILINNAGVMMCPYSKTADGFETHLGVNHLGHFLLTYLLLERLKVSAPARVVNVSSVAHHIGKIPFHDLQSEKRYSRGFAYCHSKLANVLFTRELAKRLQGTGVTTYAVHPGVVRSELVRHSSLLCLLWRLFSPFVKTAREGAQTSLHCALAEGLEPLSGKYFSDCKRTWVSPRARNNKTAERLWNVSCELLGIRWE

SEQ ID NO: 73035 - protein, 316 aa, Homo sapiens; identical to SEQ ID NO: 73034
  Payload ID: 14465
  Gene Symbol: RDH12
  Gene Name: retinol dehydrogenase 12 (all-trans/9-cis/11-cis)
  Uniprot ID: Q96NR8
  ENSP ID: ENSP00000449079

SEQ ID NO: 73036 - protein, 220 aa, Homo sapiens
  Payload ID: 14466
  Gene Symbol: RDH13
  Gene Name: retinol dehydrogenase 13 (all-trans/9-cis)
  ENSP ID: ENSP00000291892
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQG

SEQ ID NO: 73037 - protein, 260 aa, Homo sapiens
  Payload ID: 14466
  Gene Symbol: RDH13
  Gene Name: retinol dehydrogenase 13 (all-trans/9-cis)
  Uniprot ID: Q8NBN7
  ENSP ID: ENSP00000379547
MEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 73038 - protein, 331 aa, Homo sapiens
  Payload ID: 14466
  Gene Symbol: RDH13
  Gene Name: retinol dehydrogenase 13 (all-trans/9-cis)
  Uniprot ID: Q8NBN7
  ENSP ID: ENSP00000391121
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 73039 - protein, 220 aa, Homo sapiens; identical to SEQ ID NO: 73036
  Payload ID: 14466
  Gene Symbol: RDH13
  Gene Name: retinol dehydrogenase 13 (all-trans/9-cis)
  ENSP ID: ENSP00000465538

SEQ ID NO: 73040 - protein, 42 aa, Homo sapiens
  Payload ID: 14466
  Gene Symbol: RDH13
  Gene Name: retinol dehydrogenase 13 (all-trans/9-cis)
  ENSP ID: ENSP00000466708
MEKCEAAAKDIRGETLNHHVNARHLDLASLKSIREFAAKIIE

SEQ ID NO: 73041 - protein, 35 aa, Homo sapiens
  Payload ID: 14466
  Gene Symbol: RDH13
  Gene Name: retinol dehydrogenase 13 (all-trans/9-cis)
  ENSP ID: ENSP00000467208
MSRYLLPLSALGTVAGAAVLLKRQHHPGLPRHGEV

SEQ ID NO: 73042 - protein, 29 aa, Homo sapiens
  Payload ID: 14466
  Gene Symbol: RDH13
  Gene Name: retinol dehydrogenase 13 (all-trans/9-cis)
  ENSP ID: ENSP00000467754
MSRYLLPLSALGTVAGAAVLLKDYVTGGA

SEQ ID NO: 73043 - protein, 35 aa, Homo sapiens; identical to SEQ ID NO: 73041
  Payload ID: 14466
  Gene Symbol: RDH13
  Gene Name: retinol dehydrogenase 13 (all-trans/9-cis)
  ENSP ID: ENSP00000468422

SEQ ID NO: 73044 - protein, 331 aa, Homo sapiens; identical to SEQ ID NO: 73038
  Payload ID: 14466
  Gene Symbol: RDH13
  Gene Name: retinol dehydrogenase 13 (all-trans/9-cis)
  Uniprot ID: Q8NBN7
  ENSP ID: ENSP00000477512

SEQ ID NO: 73045 - protein, 35 aa, Homo sapiens; identical to SEQ ID NO: 73041
  Payload ID: 14466
  Gene Symbol: RDH13
  Gene Name: retinol dehydrogenase 13 (all-trans/9-cis)
  ENSP ID: ENSP00000477683

SEQ ID NO: 73046 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  Uniprot ID: Q8NBN7
  ENSP ID: ENSP00000477732

SEQ ID NO: 73047 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  ENSP ID: ENSP00000477884

SEQ ID NO: 73048 - protein, 35 aa, Homo sapiens; identical to SEQ ID NO: 73041
  Payload ID: 14466
  Gene Symbol: RDH13
  Gene Name: retinol dehydrogenase 13 (all-trans/9-cis)
  ENSP ID: ENSP00000478098

SEQ ID NO: 73049 - protein, 42 aa, Homo sapiens; identical to SEQ ID NO: 73040
  Payload ID: 14466
  Gene Symbol: RDH13
  Gene Name: retinol dehydrogenase 13 (all-trans/9-cis)
  ENSP ID: ENSP00000478404

SEQ ID NO: 73050 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  ENSP ID: ENSP00000479552

SEQ ID NO: 73051 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  Uniprot ID: Q8NBN7
  ENSP ID: ENSP00000480095

SEQ ID NO: 73052 - protein, 220 aa, Homo sapiens; identical to SEQ ID NO: 73036
  Payload ID: 14466
  Gene Symbol: RDH13
  Gene Name: retinol dehydrogenase 13 (all-trans/9-cis)
  ENSP ID: ENSP00000481856

SEQ ID NO: 73053 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  ENSP ID: ENSP00000482051

SEQ ID NO: 73054 - protein, 29 aa, Homo sapiens
  Payload ID: 14466
  Gene Symbol: RDH13
  Gene Name: retinol dehydrogenase 13 (all-trans/9-cis)
  ENSP ID: ENSP00000482473
MSRYLLPLSALGTVAGAAVLLKDYVTGGA

SEQ ID NO: 73055 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  ENSP ID: ENSP00000482782

SEQ ID NO: 73056 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  ENSP ID: ENSP00000482809

SEQ ID NO: 73057 - protein, 220 aa, Homo sapiens; identical to SEQ ID NO: 73036
  Payload ID: 14466
  Gene Symbol: RDH13
  Gene Name: retinol dehydrogenase 13 (all-trans/9-cis)
  ENSP ID: ENSP00000483247

SEQ ID NO: 73058 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  ENSP ID: ENSP00000484111

SEQ ID NO: 73059 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  ENSP ID: ENSP00000484246

SEQ ID NO: 73060 - protein, 260 aa, Homo sapiens; identical to SEQ ID NO: 73037
  Payload ID: 14466
  Gene Symbol: RDH13
  Gene Name: retinol dehydrogenase 13 (all-trans/9-cis)
  Uniprot ID: Q8NBN7
  ENSP ID: ENSP00000484637

SEQ ID NO: 73061 - protein, 336 aa, Homo sapiens
  Payload ID: 14467
  Gene Symbol: RDH14
  Gene Name: retinol dehydrogenase 14 (all-trans/9-cis/11-cis)
  Uniprot ID: Q9HBH5
  ENSP ID: ENSP00000370648
MAVATAAAVLAALGGALWLAARRFVGPRVQRLRRGGDPGLMHGKTVLITGANSGLGRATAAELLRLGARVIMGCRDRARAEEAAGQLRRELRQAAECGPEPGVSGVGELIVRELDLASLRSVRAFCQEMLQEEPRLDVLINNAGIFQCPYMKTEDGFEMQFGVNHLGHFLLTNLLLGLLKSSAPSRIVVVSSKLYKYGDINFDDLNSEQSYNKSFCYSRSKLANILFTRELARRLEGTNVTVNVLHPGIVRTNLGRHIHIPLLVKPLFNLVSWAFFKTPVEGAQTSIYLASSPEVEGVSGRYFGDCKEEELLPKAMDESVARKLWDISEVMVGLLK

SEQ ID NO: 73062 - protein, 317 aa, Homo sapiens
  Payload ID: 14468
  Gene Symbol: RDH16
  Gene Name: retinol dehydrogenase 16 (all-trans)
  Uniprot ID: O75452
  ENSP ID: ENSP00000381206
MWLYLAVFVGLYYLLHWYRERQVLSHLRDKYVFITGCDSGFGKLLARQLDARGLRVLAACLTEKGAEQLRGQTSDRLETVTLDVTKTESVAAAAQWVKECVRDKGLWGLVNNAGISLPTAPNELLTKQDFVTILDVNLLGVIDVTLSLLPLVRRARGRVVNVSSVMGRVSLFGGGYCISKYGVEAFSDSLRRELSYFGVKVAMIEPGYFKTAVTSKERFLKSFLEIWDRSSPEVKEAYGEKFVADYKKSAEQMEQKCTQDLSLVTNCMEHALIACHPRTRYSAGWDAKLLYLPMSYMPTFLVDAIMYWVSPSPAKAL

SEQ ID NO: 73063 - protein, 318 aa, Homo sapiens
  Payload ID: 14469
  Gene Symbol: RDH5
  Gene Name: retinol dehydrogenase 5 (11-cis/9-cis)
  Uniprot ID: Q92781
  ENSP ID: ENSP00000257895
MWLPLLLGALLWAVLWLLRDRQSLPASNAFVFITGCDSGFGRLLALQLDQRGFRVLASCLTPSGAEDLQRVASSRLHTTLLDITDPQSVQQAAKWVEMHVKEAGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 73064 - protein, 318 aa, Homo sapiens; identical to SEQ ID NO: 73063
  Payload ID: 14469
  Gene Symbol: RDH5
  Gene Name: retinol dehydrogenase 5 (11-cis/9-cis)
  Uniprot ID: Q92781
  ENSP ID: ENSP00000447128

SEQ ID NO: 73065 - protein, 103 aa, Homo sapiens
  Payload ID: 14469
  Gene Symbol: RDH5
  Gene Name: retinol dehydrogenase 5 (11-cis/9-cis)
  ENSP ID: ENSP00000447513
  MOD_RES (1)..(1): Any amino acid
XLLLGALLWAVLWLLRDRQSLPASNAFVFITGCDSGFGRLLALQLDQRGFRVLASCLTPSGAEDLQRVASSRLHTTLLDITDPQSVQQAAKWVEMHVKEAGGM

SEQ ID NO: 73066 - protein, 55 aa, Homo sapiens
  Payload ID: 14469
  Gene Symbol: RDH5
  Gene Name: retinol dehydrogenase 5 (11-cis/9-cis)
  ENSP ID: ENSP00000448014
MHVKEAGLFGLVNNAGVAGIIGPTPWLTRDDFQRVLNVNTMGPIGVTLALLPLLQ

SEQ ID NO: 73067 - protein, 221 aa, Homo sapiens
  Payload ID: 14469
  Gene Symbol: RDH5
  Gene Name: retinol dehydrogenase 5 (11-cis/9-cis)
  ENSP ID: ENSP00000449927
MHVKEAGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 73068 - protein, 79 aa, Homo sapiens
  Payload ID: 14470
  Gene Symbol: RDH8
  Gene Name: retinol dehydrogenase 8 (all-trans)
  ENSP ID: ENSP00000465773
  MOD_RES (1)..(1): Any amino acid
XFESLAIQLLQFNILFLWLSSQALTLRPCTTSGTSISQPPGSCFAPWDRTHRTWFRPLSTSSARLDHPCADRPTSATRR

SEQ ID NO: 73069 - protein, 331 aa, Homo sapiens
  Payload ID: 14470
  Gene Symbol: RDH8
  Gene Name: retinol dehydrogenase 8 (all-trans)
  ENSP ID: ENSP00000466058
MNGQSQVLPGGGHESREGINMAAAPRTVLISGCSSGIGLELAVQLAHDPKKRYQVVATMRDLGKKETLEAAAGEALGQTLTVAQLDVCSDESVAQCLSCIQGEVDVLVNNAGMGLVGPLEGLSLAAMQNVFDTNFFGAVRLVKAVLPGMKRRRQGHIVVISSVMGLQGVIFNDVYAASKFALEGFFESLAIQLLQFNIFISLVEPGPVVTEFEGKLLAQVSMAEFPGTDPETLHYFRDLYLPASRKLFCSVGQNPQDVVQAIVNVISSTRPPLRRQTNIRYSPLTTLKTVDSSGSLYVRTTHRLLFRCPRLLNLGLQCLSCGCLPTRVRPR

SEQ ID NO: 73070 - protein, 610 aa, Homo sapiens
  Payload ID: 14471
  Gene Symbol: RETSAT
  Gene Name: retinol saturase (all-trans-retinol 13,14-reductase)
  Uniprot ID: Q6NUM9
  ENSP ID: ENSP00000295802
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 73071 - protein, 255 aa, Homo sapiens
  Payload ID: 14471
  Gene Symbol: RETSAT
  Gene Name: retinol saturase (all-trans-retinol 13,14-reductase)
  ENSP ID: ENSP00000387196
  MOD_RES (1)..(1): Any amino acid
XWLPLVLLLAVLLLAVLCKVYLGLFSGSSPNPFSEDVKRPPAPLVTDKEARKKVLKQGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLT

SEQ ID NO: 73072 - protein, 320 aa, Homo sapiens
  Payload ID: 14471
  Gene Symbol: RETSAT
  Gene Name: retinol saturase (all-trans-retinol 13,14-reductase)
  ENSP ID: ENSP00000388202
  MOD_RES (1)..(1): Any amino acid
XGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGGECDCRIPTHQPVLSGCSPRCLLRG

SEQ ID NO: 73073 - protein, 399 aa, Homo sapiens
  Payload ID: 14471
  Gene Symbol: RETSAT
  Gene Name: retinol saturase (all-trans-retinol 13,14-reductase)
  ENSP ID: ENSP00000412166
  MOD_RES (1)..(1): Any amino acid
XPLVLLLAVLLLAVLCKVYLGLFSGSSPNPFSEDVKRPPAPLVTDKEARKKVLKQGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 73074 - protein, 140 aa, Homo sapiens
  Payload ID: 14471
  Gene Symbol: RETSAT
  Gene Name: retinol saturase (all-trans-retinol 13,14-reductase)
  ENSP ID: ENSP00000444814
  MOD_RES (1)..(1): Any amino acid
XFHTIPVIQRAGGAVLTKATVQSVLLDSAGKACGVSVKKGHELVNIYCPIVVSNAGLFNTYEHLLPGNARCLPGKRRVCTAPLAGSPMCPLLEPTCSVWVMLLLFLAGPLIVLKQQGENATSNIILTLAFNVGETEAHTD

SEQ ID NO: 73075 - protein, 224 aa, Homo sapiens
  Payload ID: 14472
  Gene Symbol: RS1
  Gene Name: retinoschisin 1
  Uniprot ID: O15537
  ENSP ID: ENSP00000369320
MSRKIEGFLLLLLFGYEATLGLSSTEDEGEDPWYQKACKCDCQGGPNALWSAGATSLDCIPECPYHKPLGFESGEVTPDQITCSNPEQYVGWYSSWTANKARLNSQGFGCAWLSKFQDSSQWLQIDLKEIKVISGILTQGRCDIDEWMTKYSVQYRTDERLNWIYYKDQTGNNRVFYGNSDRTSTVQNLLRPPIISRFIRLIPLGWHVRIAIRMELLECVSKCA

SEQ ID NO: 73076 - protein, 1388 aa, Homo sapiens
  Payload ID: 14473
  Gene Symbol: RGAG1
  Gene Name: retrotransposon gag domain containing 1
  Uniprot ID: Q8NET4
  ENSP ID: ENSP00000419786
MSIPLHSLRFNNTMREENVEPQNKQMAFCRPMTETRADVQILHSHVQLPIVSTSASDPGGTSTQLMTSPVFDTMSAPLMGVPNSGALSPPLMPASDSGALSPLLMPASDSGALSPLLMPALDSGTLSPLLSTSEYGVMSPGMMTIPDFGTMSATLMVAPDSAEISPLAMPAPSSGVVCTPIMSTSSSEAMSTPLMLAPDSGELSPILMQDMNPGVMSTQPVPAPSSEAMSPLQITDEDTEAMSKVLMTALASGEISSLLMSGTDSEAISSLIMSAVASGGTSPQPTSTQNSGGIPTPLMSDLDSGIMSSLLMSSPGSEVMSTPLLSVPDAGEMSTLPKPAPDAEAMSPALMTALPSGVMPTQTMPAPGSGAMSPWSTQNVDSEMMSNPPVRATASGVMSAPPVRALDSGAMSTPLMGAPASGNMSTLQKTVPASGAMTTSLMTVPSSGVMSTEQMSATASRVMSAQLTMAKTSGAMPTGSMKAVAKQYKRATASGKMSTPLRRAPTSGAMSTQPVTATASETMSMPQLTVPASGSMSMLQMRAPVSEAMSMPQMRTMASGLTSAAQMKAMTSGAMSTPLMTAQTSGSTSTLLMRDTASGVMSCPQMRSLASGALSKPLMTPKASGTMFTEKMTTTASEAMPTLLMRDTVSGALSMPQMTDTASGGLSASLMRDTASGAMSTSQMTATVSGGMSMPLMRAQDPGVMPASLMRAKVSGKMLSQPMSTQDPGGMSMSPMKSMTAGGMQMNSPTSDVMSTPTVRAWTSETMSTPLMRTSDPGERPSLLTRASSSGEMSLPLMRAPASGEIATPLRSPAYGAMSAPQMTATASGMMSSMPQVKAPISGAMSMPLTRSTASGGMSMPLMRAPDSRVTSTSQMMPTASGDMCTLPVRAPASGGVSSPLVRAPASGTMSTPLRRPSACETVSTELMRASASGHMSTAQTTAMVSGGMSKPLMRAPASGTMPMPLMSAMASGEMSMPLMETMASGATSTLQTSVANSRSMSLSQTTYTVSGRMATAPIRASASGARSTSFMRASVSGSMPMPLPRATASGCGMGMSMPQMTATDSRGMSTPLMRASGPGTMSTPQTAFGVMSTPEIKATDSGEASTSHINITASGSKPTSHMTATTPETAKPPPKEVPSFGMLTPALCYLLEEQEAARGSCSVEEEMEIDEEKQMKGFLDDSERMAFLVSLHLGAAERWFILQMEVGEPLSHENKSFLRRSQGIYDSLSEIDILSAVLCHPKQGQKSVRQYATDFLLLARHLSWSDAILRTRFLEGLSEAVTTKMGRIFLKVAGSLKELIDRSLYTECQLAEEKDSPGNSSQVLPTACKRNNEEAMGNELSSQQQTEEHQHVSKRCYYLKEHGDPQEGLHDHLGQSTGHHQKAHTNK

SEQ ID NO: 73077 - protein, 88 aa, Homo sapiens
  Payload ID: 14473
  Gene Symbol: RGAG1
  Gene Name: retrotransposon gag domain containing 1
  ENSP ID: ENSP00000430395
MSIPLHSLRFNNTMREENVEPQNKQMAFCRPMTETRADVQILHSHVQLPIVSTSASDPGGTSTQLMTSPVFDTMSAPLMGVPNSGALS

SEQ ID NO: 73078 - protein, 1388 aa, Homo sapiens; identical to SEQ ID NO: 73076
  Payload ID: 14473
  Gene Symbol: RGAG1
  Gene Name: retrotransposon gag domain containing 1
  Uniprot ID: Q8NET4
  ENSP ID: ENSP00000441452

SEQ ID NO: 73079 - protein, 569 aa, Homo sapiens
  Payload ID: 14474
  Gene Symbol: RGAG4
  Gene Name: retrotransposon gag domain containing 4
  Uniprot ID: Q5HYW3
  ENSP ID: ENSP00000418667
MSEASGNLNSLRMANVALREELNALRGENANLGLQLGRALAEVNSLRGNVSSYIRWPVPIVPVLAEENLEFALSEIEVIPGGELPFLCRPPPRAEPDCISDDLLINVIQDRSTPDGPADPPLLPIPPPPALPPPASKEPPPQPPLAPLERPEIEPFSGDPVYLAEFLMQLETFIADHEVHFPGGAERVAFLISFFTGEAKDWAISVTQEGSPLHANFPRFLDEIRKEFCGPIPPRVAKKAIRKLKQGHCTLGSYADAFQFLAQFLSWDDCRLQNQFLKGLSEFFRKELLWSTEMADLDELILECVEIERKVRVPKPIPLPGVRNIIFPFAPSPNEEESEDEEYYSEDEDQEARRHRLHSKDQRKRMRAFQQEMKEKEEEEMKKEEEMKKKEEKEEEEEEEMKQKEEEEEIRNKNEEEGESKDEEDEDEDGGQKPEGEPQQDPGTEETYGEVEEEPLDEAQDDDLDELMEMEPTFVHASSQTSGPTSGYHAENFLGASPPIIQPSRRRNQNRVPLLEGLPGTNSPFYSSPQLIRRTGRLGQRQVRRRPPVLFRLTPRQGGHRAARGRIRV

SEQ ID NO: 73080 - protein, 569 aa, Homo sapiens; identical to SEQ ID NO: 73079
  Payload ID: 14474
  Gene Symbol: RGAG4
  Gene Name: retrotransposon gag domain containing 4
  Uniprot ID: Q5HYW3
  ENSP ID: ENSP00000476792

SEQ ID NO: 73081 - protein, 1358 aa, Homo sapiens
  Payload ID: 14475
  Gene Symbol: RTL1
  Gene Name: retrotransposon-like 1
  Uniprot ID: A6NKG5
  ENSP ID: ENSP00000435342
MIEPSEDSFETMMEHKNPSSKQMESSEGSSNTTEATSGSGVRGEAGPASGPAQEKKEPPSGPLQEMEELPTDLLQDMEEPSSGPRKEIEDPPNDLLQDLEESCNGSHQARGDPLSGASDRMKEASVNPSGAREEQEAHTDLKESGREETPQEQNQTEHSTAELMAMVRSIISLYFRMQDLKEQQRVAEEILIKGINAGQLPAPKHFSGDRREFHEFIVLCQLTLQSYPRMFYNDRLRVGYVINHLSGLALEWAKALLQENSPLIGDFPAFLEAMSEVFEYRQALRVAEEAMFTIRQGGRSATEYIDEFQSLVPILGWPDEVLQAHLCQGLNEEIRHYLFRVPQPDSLDSLIVLILQIEEKLAERRAMLRLPPEARPRNLTWIDSPAPERWMVSSWLPSEVHPDINRAHLFLLLMVRVNPYHSVAVQALVDSGADGNFMDEKFAQEHYVELYEKPYPQPVQSVDGSLIGNEPVWLYTEPLVCIHQNHQESIEFDIVPSPNFSVVLGIRWLRVHAPEVDWIKGRCTFHSPYCLKNCFRPPPPCIALERHGMSLLPGLPHPYSDLADVFNPKEADDETSDQPSSDGSDDLSESEPSELQQAGDSDHSETFYECPSTAPWEPVGARMQERARLQEEYWDLQDMLTNRQDYIQMIPELFDQLHGAEWFTKLELRGTIVEESVNGHRTEDVWKAAFGLELEEMKSYQPFALSPDPIIPQNVIHFILKDMLGFFVLSYGQEVLIYSMSQEEHLHHVRQVLVRFRHHNVYCSLDKSQFHRQTVEFLGFVVTPKGVKLNKNVMTIITGYPTPGSKLSLRNFIEFVFPYRHFVERFSIIAEPLVRQLLSSYQFYWGVEEQEAFECLKRAFRKAPLLHHPKPQNPFYLETGVTGTALHASLIQIDDQTGKRACCAFYSRNISPIEVEYSQAEMKILPIRAAFMVWCRYLENTEEPIMILLNTEDLASLNNDRLTVLLPGHWVFFFSHFNFDVMELPEQDGGRALPPVRNLRWRRAFQRNTAARQTLLLASRGFPRDPSTESGEEENEEQDELNEQILRQELLAMIPIDQILNSFLAHFSMAQIRAVILHFFRGLLYWKNTLALAAILVLLRVRQCLSLRPAPAMRVARPQPQRSLRLILDSSLIAGSSITTAITQLLTQMPALVGANTIPAQELAELFLGPGRWQRNALHSQAHRGLQFTPGFWLTLCEFFGVRVTPQEGHLPALRQNRYLELHVVGDEDVVLREALQDDLQRYRQCGLHDGLQDTSQDKQDNDVQEAPPSHTAATHPPRPRHLMDPQVLEFLGSRLLHIHSADGQLHLLSREQAARALSQFLTLIYRRALPIPAWESQPREQARLEELPDEDEDANLD

SEQ ID NO: 73082 - protein, 1251 aa, Homo sapiens
  Payload ID: 14476
  Gene Symbol: REV1
  Gene Name: REV1, polymerase (DNA directed)
  Uniprot ID: Q9UBZ9
  ENSP ID: ENSP00000258428
MRRGGWRKRAENDGWETWGGYMAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 73083 - protein, 1250 aa, Homo sapiens
  Payload ID: 14476
  Gene Symbol: REV1
  Gene Name: REV1, polymerase (DNA directed)
  Uniprot ID: Q9UBZ9
  ENSP ID: ENSP00000377091
MRRGGWRKRAENDGWETWGGYMAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 73084 - protein, 97 aa, Homo sapiens
  Payload ID: 14476
  Gene Symbol: REV1
  Gene Name: REV1, polymerase (DNA directed)
  ENSP ID: ENSP00000404213
  MOD_RES (1)..(1): Any amino acid
XFLLSLSEEIQRRLEATGMKGKRLTLKIMVRKPGAPVETAKFGGHGICDNIARTVTLDQATDNAKIIGKAMLNMFHTMKLNISDMRGSPISSVKPLS

SEQ ID NO: 73085 - protein, 192 aa, Homo sapiens
  Payload ID: 14476
  Gene Symbol: REV1
  Gene Name: REV1, polymerase (DNA directed)
  ENSP ID: ENSP00000414875
MWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKADIPDSSLWENPDSAQANGIDSVLSRAEIASCSYEARSLKVLEPWLLPRVMSYHVQCCWHLNHCGATSGAWNWSIG

SEQ ID NO: 73086 - protein, 69 aa, Homo sapiens
  Payload ID: 14476
  Gene Symbol: REV1
  Gene Name: REV1, polymerase (DNA directed)
  ENSP ID: ENSP00000416274
MRRGGWRKRAENDGWETWGGYMAAKVQKLEEQFRSDAAMQKDGTSSTIFSGVAIYVNGYTDWFSCFTSH

SEQ ID NO: 73087 - protein, 3130 aa, Homo sapiens
  Payload ID: 14477
  Gene Symbol: REV3L
  Gene Name: REV3-like, polymerase (DNA directed), zeta, catalytic subunit
  Uniprot ID: O60673
  ENSP ID: ENSP00000351697
MFSVRIVTADYYMASPLQGLDTCQSPLTQAPVKKVPVVRVFGATPAGQKTCLHLHGIFPYLYVPYDGYGQQPESYLSQMAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHTTLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRIHKATSSSRSEPEGRKGTISQYFTTLHCPVCDDLTQHGICSKCRSQPQHVAVILNQEIRELERQQEQLVKICKNCTGCFDRHIPCVSLNCPVLFKLSRVNRELSKAPYLRQLLDQF

SEQ ID NO: 73088 - protein, 3130 aa, Homo sapiens; identical to SEQ ID NO: 73087
  Payload ID: 14477
  Gene Symbol: REV3L
  Gene Name: REV3-like, polymerase (DNA directed), zeta, catalytic subunit
  Uniprot ID: O60673
  ENSP ID: ENSP00000357792

SEQ ID NO: 73089 - protein, 3130 aa, Homo sapiens; identical to SEQ ID NO: 73087
  Payload ID: 14477
  Gene Symbol: REV3L
  Gene Name: REV3-like, polymerase (DNA directed), zeta, catalytic subunit
  Uniprot ID: O60673
  ENSP ID: ENSP00000357795

SEQ ID NO: 73090 - protein, 47 aa, Homo sapiens
  Payload ID: 14477
  Gene Symbol: REV3L
  Gene Name: REV3-like, polymerase (DNA directed), zeta, catalytic subunit
  ENSP ID: ENSP00000391605
MFSVRIVTADYYMASPLQGLDTCQSPLTQAPVKKVPVVRVFGATPAE

SEQ ID NO: 73091 - protein, 47 aa, Homo sapiens; identical to SEQ ID NO: 73090
  Payload ID: 14477
  Gene Symbol: REV3L
  Gene Name: REV3-like, polymerase (DNA directed), zeta, catalytic subunit
  ENSP ID: ENSP00000393184

SEQ ID NO: 73092 - protein, 184 aa, Homo sapiens
  Payload ID: 14477
  Gene Symbol: REV3L
  Gene Name: REV3-like, polymerase (DNA directed), zeta, catalytic subunit
  ENSP ID: ENSP00000400600
RPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEISDIRLHYLLDLELQDSKSPMLLMRRHFFMKLQI

SEQ ID NO: 73093 - protein, 3052 aa, Homo sapiens
  Payload ID: 14477
  Gene Symbol: REV3L
  Gene Name: REV3-like, polymerase (DNA directed), zeta, catalytic subunit
  Uniprot ID: O60673
  ENSP ID: ENSP00000402003
MAFSIDRALNVALGNPSSTAQHVFKVSLVSGMPFYGYHEKERHFMKIYLYNPTMVKRICELLQSGAIMNKFYQPHEAHIPYLLQLFIDYNLYGMNLINLAAVKFRKARRKSNTLHATGSCKNHLSGNSLADTLFRWEQDEIPSSLILEGVEPQSTCELEVDAVAADILNRLDIEAQIGGNPGLQAIWEDEKQRRRNRNETSQMSQPESQDHRFVPATESEKKFQKRLQEILKQNDFSVTLSGSVDYSDGSQEFSAELTLHSEVLSPEMLQCTPANMVEVHKDKESSKGHTRHKVEEALINEEAILNLMENSQTFQPLTQRLSESPVFMDSSPDEALVHLLAGLESDGYRGERNRMPSPCRSFGNNKYPQNSDDEENEPQIEKEEMELSLVMSQRWDSNIEEHCAKKRSLCRNTHRSSTEDDDSSSGEEMEWSDNSLLLASLSIPQLDGTADENSDNPLNNENSRTHSSVIATSKLSVKPSIFHKDAATLEPSSSAKITFQCKHTSALSSHVLNKEDLIEDLSQTNKNTEKGLDNSVTSFTNESTYSMKYPGSLSSTVHSENSHKENSKKEILPVSSCESSIFDYEEDIPSVTRQVPSRKYTNIRKIEKDSPFIHMHRHPNENTLGKNSFNFSDLNHSKNKVSSEGNEKGNSTALSSLFPSSFTENCELLSCSGENRTMVHSLNSTADESGLNKLKIRYEEFQEHKTEKPSLSQQAAHYMFFPSVVLSNCLTRPQKLSPVTYKLQPGNKPSRLKLNKRKLAGHQETSTKSSETGSTKDNFIQNNPCNSNPEKDNALASDLTKTTRGAFENKTPTDGFIDCHFGDGTLETEQSFGLYGNKYTLRAKRKVNYETEDSESSFVTHNSKISLPHPMEIGESLDGTLKSRKRRKMSKKLPPVIIKYIIINRFRGRKNMLVKLGKIDSKEKQVILTEEKMELYKKLAPLKDFWPKVPDSPATKYPIYPLTPKKSHRRKSKHKSAKKKTGKQQRTNNENIKRTLSFRKKRSHAILSPPSPSYNAETEDCDLNYSDVMSKLGFLSERSTSPINSSPPRCWSPTDPRAEEIMAAAEKEAMLFKGPNVYKKTVNSRIGKTSRARAQIKKSKAKLANPSIVTKKRNKRNQTNKLVDDGKKKPRAKQKTNEKGTSRKHTTLKDEKIKSQSGAEVKFVLKHQNVSEFASSSGGSQLLFKQKDMPLMGSAVDHPLSASLPTGINAQQKLSGCFSSFLESKKSVDLQTFPSSRDDLHPSVVCNSIGPGVSKINVQRPHNQSAMFTLKESTLIQKNIFDLSNHLSQVAQNTQISSGMSSKIEDNANNIQRNYLSSIGKLSEYRNSLESKLDQAYTPNFLHCKDSQQQIVCIAEQSKHSETCSPGNTASEESQMPNNCFVTSLRSPIKQIAWEQKQRGFILDMSNFKPERVKPRSLSEAISQTKALSQCKNRNVSTPSAFGEGQSGLAVLKELLQKRQQKAQNANTTQDPLSNKHQPNKNISGSLEHNKANKRTRSVTSPRKPRTPRSTKQKEKIPKLLKVDSLNLQNSSQLDNSVSDDSPIFFSDPGFESCYSLEDSLSPEHNYNFDINTIGQTGFCSFYSGSQFVPADQNLPQKFLSDAVQDLFPGQAIEKNEFLSHDNQKCDEDKHHTTDSASWIRSGTLSPEIFEKSTIDSNENRRHNQWKNSFHPLTTRSNSIMDSFCVQQAEDCLSEKSRLNRSSVSKEVFLSLPQPNNSDWIQGHTRKEMGQSLDSANTSFTAILSSPDGELVDVACEDLELYVSRNNDMLTPTPDSSPRSTSSPSQSKNGSFTPRTANILKPLMSPPSREEIMATLLDHDLSETIYQEPFCSNPSDVPEKPREIGGRLLMVETRLANDLAEFEGDFSLEGLRLWKTAFSAMTQNPRPGSPLRSGQGVVNKGSSNSPKMVEDKKIVIMPCKCAPSRQLVQVWLQAKEEYERSKKLPKTKPTGVVKSAENFSSSVNPDDKPVVPPKMDVSPCILPTTAHTKEDVDNSQIALQAPTTGCSQTASESQMLPPVASASDPEKDEDDDDNYYISYSSPDSPVIPPWQQPISPDSKALNGDDRPSSPVEELPSLAFENFLKPIKDGIQKSPCSEPQEPLVISPINTRARTGKCESLCFHSTPIIQRKLLERLPEAPGLSPLSTEPKTQKLSNKKGSNTDTLRRVLLTQAKNQFAAVNTPQKETSQIDGPSLNNTYGFKVSIQNLQEAKALHEIQNLTLISVELHARTRRDLEPDPEFDPICALFYCISSDTPLPDTEKTELTGVIVIDKDKTVFSQDIRYQTPLLIRSGITGLEVTYAADEKALFHEIANIIKRYDPDILLGYEIQMHSWGYLLQRAAALSIDLCRMISRVPDDKIENRFAAERDEYGSYTMSEINIVGRITLNLWRIMRNEVALTNYTFENVSFHVLHQRFPLFTFRVLSDWFDNKTDLYRWKMVDHYVSRVRGNLQMLEQLDLIGKTSEMARLFGIQFLHVLTRGSQYRVESMMLRIAKPMNYIPVTPSVQQRSQMRAPQCVPLIMEPESRFYSNSVLVLDFQSLYPSIVIAYNYCFSTCLGHVENLGKYDEFKFGCTSLRVPPDLLYQVRHDITVSPNGVAFVKPSVRKGVLPRMLEEILKTRFMVKQSMKAYKQDRALSRMLDARQLGLKLIANVTFGYTSANFSGRMPCIEVGDSIVHKARETLERAIKLVNDTKKWGARVVYGDTDSMFVLLKGATKEQSFKIGQEIAEAVTATNPKPVKLKFEKVYLPCVLQTKKRYVGYMYETLDQKDPVFDAKGIETVRRDSCPAVSKILERSLKLLFETRDISLIKQYVQRQCMKLLEGKASIQDFIFAKEYRGSFSYKPGACVPALELTRKMLTYDRRSEPQVGERVPYVIIYGTPGVPLIQLVRRPVEVLQDPTLRLNATYYITKQILPPLARIFSLIGIDVFSWYHELPRIHKATSSSRSEPEGRKGTISQYFTTLHCPVCDDLTQHGICSKCRSQPQHVAVILNQEIRELERQQEQLVKICKNCTGCFDRHIPCVSLNCPVLFKLSRVNRELSKAPYLRQLLDQF

SEQ ID NO: 73094 - protein, 323 aa, Homo sapiens [sequence omitted]

SEQ ID NO: 73095 - protein, 971 aa, Homo sapiens
  Payload ID: 14478
  Gene Symbol: RECK
  Gene Name: reversion-inducing-cysteine-rich protein with kazal motifs
  Uniprot ID: O95980
  ENSP ID: ENSP00000367202
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFRTDSSPGPSQIKAVENYCASISPQLIHCVNNYTQSYPMRNPTDSLYCCDRAEDHACQNACKRILMSKKTEMEIVDGLIEGCKTQPLPQDPLWQCFLESSQSVHPGVTVHPPPSTGLDGAKLHCCSKANTSTCRELCTKLYSMSWGNTQSWQEFDRFCEYNPVEVSMLTCLADVREPCQLGCRNLTYCTNFNNRPTELFRSCNAQSDQGAMNDMKLWEKGSIKMPFINIPVLDIKKCQPEMWKAIACSLQIKPCHSKSRGSIICKSDCVEILKKCGDQNKFPEDHTAESICELLSPTDDLKNCIPLDTYLRPSTLGNIVEEVTHPCNPNPCPANELCEVNRKGCPSGDPCLPYFCVQGCKLGEASDFIVRQGTLIQVPSSAGEVGCYKICSCGQSGLLENCMEMHCIDLQKSCIVGGKRKSHGTSFSIDCNVCSCFAGNLVCSTRLCLSEHSSEDDRRTFTGLPCNCADQFVPVCGQNGRTYPSACIARCVGLQDHQFEFGSCMSKDPCNPNPCQKNQRCIPKPQVCLTTFDKFGCSQYECVPRQLACDQVQDPVCDTDHMEHNNLCTLYQRGKSLSYKGPCQPFCRATEPVCGHNGETYSSVCAAYSDRVAVDYYGDCQAVGVLSEHSSVAECASVKCPSLLAAGCKPIIPPGACCPLCAGMLRVLFDKEKLDTIAKVTNKKPITVLEILQKIRMHVSVPQCDVFGYFSIESEIVILIIPVDHYPKALQIEACNKEAEKIESLINSDSPTLASHVPLSALIISQVQVSSSVPSAGVRARPSCHSLLLPLSLGLALHLLWTYN

SEQ ID NO: 73096 - protein, 1221 aa, Homo sapiens
  Payload ID: 14479
  Gene Symbol: REXO1
  Gene Name: REX1, RNA exonuclease 1 homolog
  Uniprot ID: Q8N1G1
  ENSP ID: ENSP00000170168
MLRSTGFFRAIDCPYWSGAPGGPCRRPYCHFRHRGARGSGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQSSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 73097 - protein, 161 aa, Homo sapiens
  Payload ID: 14479
  Gene Symbol: REXO1
  Gene Name: REX1, RNA exonuclease 1 homolog
  ENSP ID: ENSP00000468713
  MOD_RES (1)..(1): Any amino acid
XAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKGPNQ

SEQ ID NO: 73098 - protein, 123 aa, Homo sapiens
  Payload ID: 14479
  Gene Symbol: REXO1
  Gene Name: REX1, RNA exonuclease 1 homolog
  ENSP ID: ENSP00000480368
  MOD_RES (1)..(1): Any amino acid
XTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMVRLFSAQRRVQDW

SEQ ID NO: 73099 - protein, 64 aa, Homo sapiens
  Payload ID: 14479
  Gene Symbol: REXO1
  Gene Name: REX1, RNA exonuclease 1 homolog
  ENSP ID: ENSP00000481515
  MOD_RES (1)..(1): Any amino acid
XTTTIIPKRIAHSPSLQSLKKPIIPKEFGGKVPTVIRQRYLNLFIEECLKFCTSNQEAIEKPQL

SEQ ID NO: 73100 - protein, 422 aa, Homo sapiens
  Payload ID: 14480
  Gene Symbol: REXO4
  Gene Name: REX4 homolog, 3,-5, exonuclease
  ENSP ID: ENSP00000486065
MGKAKVPASKRAPSSPVAKPGPVKTLTRKKNKKKKRFWKSKAREVSKKPASGPGAVVRPPKAPEDFSQNWKALQEWLLKQKSQAPEKPLVISQMGSKKKPKIIQQNKKETSPQVKGEEMPAGKDQEASRGSVPSGSKMDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKPTEPVTDYRTAVSGIRPENLKQGEELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMARDRRPLLTAPDHCSDDA

SEQ ID NO: 73101 - protein, 233 aa, Homo sapiens
  Payload ID: 14480
  Gene Symbol: REXO4
  Gene Name: REX4 homolog, 3,-5, exonuclease
  ENSP ID: ENSP00000486474
MGKAKVPASKRAPSSPVAKPGPVKTLTRKKNKKKKRFWKSKAREVSKKPASGPGAVVRPPKAPEDFSQNWKALQEVPRWTGGRQYLAPRPVEQSTIRKEPRKGQMVILFQNEGTSSIRSGKLRRQPQPHPPREELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMA

SEQ ID NO: 73102 - protein, 189 aa, Homo sapiens
  Payload ID: 14480
  Gene Symbol: REXO4
  Gene Name: REX4 homolog, 3,-5, exonuclease
  ENSP ID: ENSP00000486690
MGSKKKPKIIQQNKKETSPQVKGEEMPAGKDQEASRGSVPSGSKMDRRAPVPRTKASGTEHNKKGTKERTNGDIVPERGDIEHKKRKAKEAAPAPPTEEDIWFDDVDPADIEAAIGPEAAKIARKQLGQSEGSVSLSLVKEQAFGGLTRALALDCEMVGVGPKGEESMAARVSIVNQYGKCVYDKYVKP

SEQ ID NO: 73103 - protein, 250 aa, Homo sapiens
  Payload ID: 14480
  Gene Symbol: REXO4
  Gene Name: REX4 homolog, 3,-5, exonuclease
  ENSP ID: ENSP00000487504
MGKAKVPASKRAPSSPVAKPGPVKTLTRKKNKKKKRFWKSKAREVSKKPASGPGAVVRPPKAPEDFSQNWKALQEVPRWTGGRQYLAPRPVEQSTIRKEPRKGQMVILFQNEGTSSIRSGKLRRQPQPHPPREELEVVQKEVAEMLKGRILVGHALHNDLKVLFLDHPKKKIRDTQKYKPFKSQVKSGRPSLRLLSEKILGLQVQQAEHCSIQDAQAAMRLYVMVKKEWESMARDRRPLLTAPDHCSDDA

SEQ ID NO: 73104 - protein, 250 aa, Homo sapiens; identical to SEQ ID NO: 73103
  Payload ID: 14481
  Gene Symbol: REXO4
  Gene Name: REX4 homolog, 3'-5' exonuclease
  Uniprot ID: Q9GZR2
  ENSP ID: ENSP00000361003

SEQ ID NO: 73105 - protein, 422 aa, Homo sapiens; identical to SEQ ID NO: 73100
  Payload ID: 14481
  Gene Symbol: REXO4
  Gene Name: REX4 homolog, 3'-5' exonuclease
  Uniprot ID: Q9GZR2
  ENSP ID: ENSP00000361010

SEQ ID NO: 73106 - protein, 189 aa, Homo sapiens; identical to SEQ ID NO: 73102
  Payload ID: 14481
  Gene Symbol: REXO4
  Gene Name: REX4 homolog, 3'-5' exonuclease
  ENSP ID: ENSP00000391534

SEQ ID NO: 73107 - protein, 233 aa, Homo sapiens; identical to SEQ ID NO: 73101
  Payload ID: 14481
  Gene Symbol: REXO4
  Gene Name: REX4 homolog, 3'-5' exonuclease
  ENSP ID: ENSP00000394229

SEQ ID NO: 73108 - protein, 331 aa, Homo sapiens
  Payload ID: 14482
  Gene Symbol: RFNG
  Gene Name: RFNG O-fucosylpeptide 3-beta-N-acetylglucosaminyltransferase
  Uniprot ID: Q9Y644
  ENSP ID: ENSP00000307971
MSRARGALCRACLALAAALAALLLLPLPLPRAPAPARTPAPAPRAPPSRPAAPSLRPDDVFIAVKTTRKNHGPRLRLLLRTWISRARQQTFIFTDGDDPELELQGGDRVINTNCSAVRTRQALCCKMSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPHNVVNVAGGFSLHQDPTRFKSIHCLLYPDTDWCPRQKQGAPTSR

SEQ ID NO: 73109 - protein, 205 aa, Homo sapiens
  Payload ID: 14482
  Gene Symbol: RFNG
  Gene Name: RFNG O-fucosylpeptide 3-beta-N-acetylglucosaminyltransferase
  ENSP ID: ENSP00000402931
MSVEYDKFIESGRKWFCHVDDDNYVNARSLLHLLSSFSPSQDVYLGRPSLDHPIEATERVQGGRTVTTVKFWFATGGAGFCLSRGLALKMSPWASLGSFMSTAEQVRLPDDCTVGYIVEGLLGARLLHSPLFHSHLENLQRLPPDTLLQQVTLSHGGPENPHNVVNVAGGFSLHQDPTRFKSIHCLLYPDTDWCPRQKQGAPTSR

SEQ ID NO: 73110 - protein, 60 aa, Homo sapiens
  Payload ID: 14482
  Gene Symbol: RFNG
  Gene Name: RFNG O-fucosylpeptide 3-beta-N-acetylglucosaminyltransferase
  ENSP ID: ENSP00000463623
MSVEYDKFIESGRKWFCHVDDDNYVNARSLLHLLSSFSPSQDVYLGRPSLDHPIEATERV

SEQ ID NO: 73111 - protein, 69 aa, Homo sapiens
  Payload ID: 14483
  Gene Symbol: RFPL3S
  Gene Name: RFPL3 antisense
  ENSP ID: ENSP00000371516
MGNLSSCIKVPPEDQWKVDSKEWASEDPFSVTKVTPRNTVNVAAYLASPGRTGASVVPEFIKGQMLKTP

SEQ ID NO: 73112 - protein, 76 aa, Homo sapiens
  Payload ID: 14483
  Gene Symbol: RFPL3S
  Gene Name: RFPL3 antisense
  ENSP ID: ENSP00000371518
MGNLSSCIKVPPEDQWKVDSKEWASEDPFSVTKVTPRNTVNEILRRYSLYTKRHMTQPGLWANHRVHSHEGTVEIY

SEQ ID NO: 73113 - protein, 98 aa, Homo sapiens [sequence omitted]

SEQ ID NO: 73114 - protein, 69 aa, Homo sapiens
  Payload ID: 14483
  Gene Symbol: RFPL3S
  Gene Name: RFPL3 antisense
  ENSP ID: ENSP00000463921
MGNLSSCIKVPPEDQWKVDSKEWASEDPFSVTKVTPRNTVNEILRRYSLYTKRHMTQPGLWANHRVHSH

SEQ ID NO: 73115 - protein, 107 aa, Homo sapiens
  Payload ID: 14483
  Gene Symbol: RFPL3S
  Gene Name: RFPL3 antisense
  Uniprot ID: P0C7P2
  ENSP ID: ENSP00000482492
MQTDTSNLSARSCRFCVMSPLRTLLRSSEMRRKLLAVSASKVISTVKRKTSCSASGQKPTPCLSSTSKAQISPDFSFFNSVSSSKIKTFHEETSLFQIFIGMLCGNT

SEQ ID NO: 73116 - protein, 541 aa, Homo sapiens
  Payload ID: 14484
  Gene Symbol: RFT1
  Gene Name: RFT1 homolog
  Uniprot ID: Q96AA3
  ENSP ID: ENSP00000296292
MGSQEVLGHAARLASSGLLLQVLFRLITFVLNAFILRFLSKEIVGVVNVRLTLLYSTTLFLAREAFRRACLSGGTQRDWSQTLNLLWLTVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 73117 - protein, 502 aa, Homo sapiens
  Payload ID: 14484
  Gene Symbol: RFT1
  Gene Name: RFT1 homolog
  ENSP ID: ENSP00000378223
MGSQEVLGHAARLASSGLLLQVLFRLITFVLNAFILRFLSKEIVGVVNVRVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 73118 - protein, 291 aa, Homo sapiens
  Payload ID: 14484
  Gene Symbol: RFT1
  Gene Name: RFT1 homolog
  ENSP ID: ENSP00000420325
MGSQEVLGHAARLASSGLLLQVLFRLITFVLNAFILRFLSKEIVGVVNVRLTLLYSTTLFLAREAFRRACLSGGTQRDWSQTLNLLWLTVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLAL

SEQ ID NO: 73119 - protein, 473 aa, Homo sapiens
  Payload ID: 14485
  Gene Symbol: RFX8
  Gene Name: RFX family member 8, lacking RFX DNA binding domain
  Uniprot ID: Q6ZV50
  ENSP ID: ENSP00000401536
MYEIYVETCGQNTENQVNPATFGKCEDHSPMKTDPVGSPLSEFRRCPFLEQEQAKKYSCNMMAFLADEYCNYCRDILRNVEDLLTSFWKSLQQDTVMLMSLPDVCQLFKCYDVQLYKGIEDVLLHDFLEDVSIQYLKSVQLFSKKFKLWLLNALEGVPALLQISKLKEVTLFVKRLRRKTYLSNMAKTMRMVLKSKRRVSVLKSDLQAIINQGTLATSKKALASDRSGADELENNPEMKCLRNLISLLGTSTDLRVFLSCLSSHLQAFVFQTSRSKEEFTKLAASFQLRWNLLLTAVSKAMTLCHRDSFGSWHLFHLLLLEYMIHILQSCLEEEEEEEDMGTVKEMLPDDPTLGQPDQALFHSLNSSLSQACASPSMEPLGVMPTHMGQGRYPVGVSNMVLRILGFLVDTAMGNKLIQVLLEDETTESAVKLSLPMGQEALITLKDGQQFVIQISDVPQSSEDIYFRENNANV

SEQ ID NO: 73120 - protein, 153 aa, Homo sapiens
  Payload ID: 14485
  Gene Symbol: RFX8
  Gene Name: RFX family member 8, lacking RFX DNA binding domain
  ENSP ID: ENSP00000422968
MYEIYVETCGQNTENQVNPATFGKLVRLVFPDLGTRRLGTRGSARYHYDGICIKKSSFFYAQYCYLIGEKRYHSGDAIAFEKSTNYNSIIQQEATCEDHSPMKTDPVGSPLSEFRRCPFLEQEQAKKYSCNMMAFLADEYCNYCRDILRNVRN

SEQ ID NO: 73121 - protein, 80 aa, Homo sapiens
  Payload ID: 14485
  Gene Symbol: RFX8
  Gene Name: RFX family member 8, lacking RFX DNA binding domain
  ENSP ID: ENSP00000424661
MYEIYVETCGQNTENQVNPATFGKLVRLVFPDLGTRRLGTRGSARYHYDGICIKKSSFFYAQYCYLIGEKRYHSVKIIHR

SEQ ID NO: 73122 - protein, 1435 aa, Homo sapiens
  Payload ID: 14486
  Gene Symbol: RLTPR
  Gene Name: RGD motif, leucine rich repeats, tropomodulin domain and proline-rich containing
  Uniprot ID: Q6F5E8
  ENSP ID: ENSP00000334958
MAQTPDGISCELRGEITRFLWPKEVELLLKTWLPGEGAVQNHVLALLRWRAYLLHTTCLPLRVDCTFSYLEVQAMALQETPPQVTFELESLRELVLEFPGVAALEQLAQHVAAAIKKVFPRSTLGKLFRRPTPASMLARLERSSPSESTDPCSPCGGFLETYEALCDYNGFPFREEIQWDVDTIYHRQGCRHFSLGDFSHLGSRDLALSVAALSYNLWFRCLSCVDMKLSLEVSEQILHMMSQSSHLEELVLETCSLRGDFVRRLAQALAGHSSSGLRELSLAGNLLDDRGMTALSRHLERCPGALRRLSLAQTGLTPRGMRALGRALATNAAFDSTLTHLDLSGNPGALGASEDSGGLYSFLSRPNVLSFLNLAGTDTALDTVRGCSVGGWMTGRADWRAGRGGLGPPAGVANSLPPQLFAAVSRGCCTSLTHLDASRNVFSRTKSRAAPAALQLFLSRARTLRHLGLAGCKLPPDALRALLDGLALNTHLRDLHLDLSACELRSAGAQVIQDLVCDAGAVSSLDLADNGFGSDMVTLVLAIGRSRSLRHVALGRNFNVRCKETLDDVLHRIVQLMQDDDCPLQSLSVAESRLKLGASVLLRALATNPNLTALDISGNAMGDAGAKLLAKALRVNSRLRSVVWDRNHTSALGLLDVAQALEQNHSLKAMPLPLNDVAQAQRSRPELTARAVHQIQACLLRNNRADPASSDHTTRLQPLGLVSDPSEQEVNELCQSVQEHVELLGCGAGPQGEAAVRQAEDAIQNANFSLSILPILYEAGSSPSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEDGQLRPRPLSAGRRAVSVHEDQLQAPAERPLRLQRSPVLKRRPKLEAPPSPSLGSGLGTEPLPPQPTEPSSPERSPPSPATDQRGGGPNP

SEQ ID NO: 73123 - protein, 1372 aa, Homo sapiens
  Payload ID: 14486
  Gene Symbol: RLTPR
  Gene Name: RGD motif, leucine rich repeats, tropomodulin domain and proline-rich containing
  Uniprot ID: Q6F5E8
  ENSP ID: ENSP00000441481
MAQTPDGISCELRGEITRFLWPKEVELLLKTWLPGEGAVQNHVLALLRWRAYLLHTTCLPLRVDCTFSYLEVQAMALQETPPQVTFELESLRELVLEFPGVAALEQLAQHVAAAIKKVFPRSTLGKLFRRPTPASMLARLERSSPSESTDPCSPCGGFLETYEALCDYNGFPFREEIQWDVDTIYHRQGCRHFSLGDFSHLGSRDLALSVAALSYNLWFRCLSCVDMKLSLEVSEQILHMMSQSSHLEELVLETCSLRGDFVRRLAQALAGHSSSGLRELSLAGNLLDDRGMTALSRHLERCPGALRRLSLAQTGLTPRGMRALGRALATNAAFDSTLTHLDLSGNPGALGASEDSGGLYSFLSRPNVLSFLNLAGTDTALDTLFAAVSRGCCTSLTHLDASRNVFSRTKSRAAPAALQLFLSRARTLRHLGLAGCKLPPDALRALLDGLALNTHLRDLHLDLSACELRSAGAQVIQDLVCDAGAVSSLDLADNGFGSDMVTLVLAIGRSRSLRHVALGRNFNVRCKETLDDVLHRIVQLMQDDDCPLQSLSVAESRLKLGASVLLRALATNPNLTALDISGNAMGDAGAKLLAKALRVNSRLRSVVWDRNHTSALGLLDVAQALEQNHSLKAMPLPLNDVAQAQRSRPELTARAVHQIQACLLRNNRADPASSDHTTRLQPLGLVSDPSEQEVNELCQSVQEHVELLGCGAGPQGEAAVRQAEDAIQNANFSLSILPILYEAGSSPSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEERPLRLQRSPVLKRRPKLEAPPSPSLGSGLGTEPLPPQPTEPSSPERSPPSPATDQRGGGPNP

SEQ ID NO: 73124 - protein, 124 aa, Homo sapiens
  Payload ID: 14486
  Gene Symbol: RLTPR
  Gene Name: RGD motif, leucine rich repeats, tropomodulin domain and proline-rich containing
  ENSP ID: ENSP00000473419
  MOD_RES (1)..(1): Any amino acid
XRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGLVPESPAPPCR

SEQ ID NO: 73125 - protein, 55 aa, Homo sapiens
  Payload ID: 14486
  Gene Symbol: RLTPR
  Gene Name: RGD motif, leucine rich repeats, tropomodulin domain and proline-rich containing
  ENSP ID: ENSP00000473580
MAQTPDGISCELRGTATMESLPAAHHLPPAEGGLHVQLPGGPGHGAAGDTPSGHL

SEQ ID NO: 73126 - protein, 391 aa, Homo sapiens
  Payload ID: 14487
  Gene Symbol: RGP1
  Gene Name: RGP1 homolog, RAB6A GEF complex partner 1
  Uniprot ID: Q92546
  ENSP ID: ENSP00000367318
MIEVVAELSRGPVFLAGEALECVVTVTNPLPPTATSASSEALAWASAQIHCQFHASESRVALPPPDSSQPDVQPDSQTVFLPHRGERGQCILSTPPKILFCDLRLDPGESKSYSYSEVLPIEGPPSFRGQSVKYVYKLTIGCQRVNSPITLLRVPLRVLVLTGLQDVRFPQDEAVAPSSPFLEEDEGGKKDSWLAELAGERLMAATSCRSLHLYNISDGRGKVGTFGIFKSVYRLGEDVVGTLNLGEGTVACLQFSVSLQTEERVQPEYQRRRGAGGVPSVSHVTHARHQESCLHTTRTSFSLPIPLSSTPGFCTAIVSLKWRLHFEFVTSREPGLVLLPPVEQPEPTTWTGPEQVPVDTFSWDLPIKVLPTSPTLASYAAPGPSTSTITI

SEQ ID NO: 73127 - protein, 398 aa, Homo sapiens
  Payload ID: 14488
  Gene Symbol: RHCE
  Gene Name: Rh blood group, CcEe antigens
  ENSP ID: ENSP00000243186
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIPHLRHALHLQLAGSAWRDHLHCAAGASYCLERQWHDWLPGPPQHWGTQLGHRDSSHVWSPDRFAPKSQNMESTSCG

SEQ ID NO: 73128 - protein, 417 aa, Homo sapiens
  Payload ID: 14488
  Gene Symbol: RHCE
  Gene Name: Rh blood group, CcEe antigens
  Uniprot ID: P18577
  ENSP ID: ENSP00000294413
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIHHISVMHSIFSLLGLLGEITYIVLLVLHTVWNGNGMIGFQVLLSIGELSLAIVIALTSGLLTGLLLNLKIWKAPHVAKYFDDQVFWKFPHLAVGF

SEQ ID NO: 73129 - protein, 401 aa, Homo sapiens
  Payload ID: 14488
  Gene Symbol: RHCE
  Gene Name: Rh blood group, CcEe antigens
  ENSP ID: ENSP00000311185
MYFINQRLFLRLWRVPVMRASHCYQSQGWRPVAVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIHHISVMHSIFSLLGLLGEITYIVLLVLHTVWNGNGMIGFQVLLSIGELSLAIVIALTSGLLTGLLLNLKIWKAPHVAKYFDDQVFWKFPHLAVGF

SEQ ID NO: 73130 - protein, 354 aa, Homo sapiens
  Payload ID: 14488
  Gene Symbol: RHCE
  Gene Name: Rh blood group, CcEe antigens
  ENSP ID: ENSP00000334570
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPDWLPGPPQHWGTQLGHRDSSHVWSPDRFAPKSQNMESTSCG

SEQ ID NO: 73131 - protein, 266 aa, Homo sapiens
  Payload ID: 14488
  Gene Symbol: RHCE
  Gene Name: Rh blood group, CcEe antigens
  ENSP ID: ENSP00000344485
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNVCCNRVLGIHHISVMHSIFSLLGLLGEITYIVLLVLHTVWNGNGMIGFQVLLSIGELSLAIVIALTSGLLTGLLLNLKIWKAPHVAKYFDDQVFWKFPHLAVGF

SEQ ID NO: 73132 - protein, 267 aa, Homo sapiens
  Payload ID: 14488
  Gene Symbol: RHCE
  Gene Name: Rh blood group, CcEe antigens
  ENSP ID: ENSP00000345084
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTYVHSAVLAGGVAVGTSCHLIPSPWLAMVLGLVAGLISIGGAKCLPVCCNRVLGIHHISVMHSIFSLLGLLGEITYIVLLVLHTVWNGNGMFAPKSQNMESTSCG

SEQ ID NO: 73133 - protein, 302 aa, Homo sapiens
  Payload ID: 14488
  Gene Symbol: RHCE
  Gene Name: Rh blood group, CcEe antigens
  ENSP ID: ENSP00000363472
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAG

SEQ ID NO: 73134 - protein, 372 aa, Homo sapiens
  Payload ID: 14488
  Gene Symbol: RHCE
  Gene Name: Rh blood group, CcEe antigens
  ENSP ID: ENSP00000415417
MSSKYPRSVRRCLPLCALTLEAALILLFYFFTHYDASLEDQKGLVASYQVGQDLTVMAALGLGFLTSNFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNLRHFYVFAAYFGLTVAWCLPKPLPKGTEDNDQRATIPSLSAMLGALFLWMFWPSVNSALLRSPIQRKNAMFNTYYALAVSVVTAISGSSLAHPQRKISMTYVHSAVLAGGVAVGTSCHLIPSPWLAMVLGLVAGLISIGGAKCLPVCCNRVLGIHHISVMHSIFSLLGLLGEITYIVLLVLHTVWNGNGMFAPKSQNMESTSCG

SEQ ID NO: 73135 - protein, 77 aa, Homo sapiens
  Payload ID: 14488
  Gene Symbol: RHCE
  Gene Name: Rh blood group, CcEe antigens
  ENSP ID: ENSP00000431741
  MOD_RES (1)..(1): Any amino acid
XGAVLGKVNLAQLVVMVLVEVTALGTLRMVISNIFNDWLPGPPQHWGTQLGHRDSSHVWSPDRFAPKSQNMESTSCG

SEQ ID NO: 73136 - protein, 55 aa, Homo sapiens
  Payload ID: 14488
  Gene Symbol: RHCE
  Gene Name: Rh blood group, CcEe antigens
  ENSP ID: ENSP00000435401
MSSKYPRSVRRCLPLCALTLEAALILLFYFFTHYDASLEDQKGLVASYQVFGWPP

SEQ ID NO: 73137 - protein, 417 aa, Homo sapiens
  Payload ID: 14489
  Gene Symbol: RHD
  Gene Name: Rh blood group, D antigen
  Uniprot ID: Q02161
  ENSP ID: ENSP00000331871
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMIGFQVLLSIGELSLAIVIALMSGLLTGLLLNLKIWKAPHEAKYFDDQVFWKFPHLAVGF

SEQ ID NO: 73138 - protein, 493 aa, Homo sapiens
  Payload ID: 14489
  Gene Symbol: RHD
  Gene Name: Rh blood group, D antigen
  Uniprot ID: Q02161
  ENSP ID: ENSP00000339577
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMSLGWNLAVKMAEAGDEELMRLDVSQRNHGGAAVPTGSWMPSTETTIAPNYRDHISVVSSFGCWILSKSIQEKQGLFKNKTTSSHCCLHLYVRNAHDSKVSNVRAGTGVRENGVESFLCHSLRRISPFIMHCRIQQ

SEQ ID NO: 73139 - protein, 396 aa, Homo sapiens
  Payload ID: 14489
  Gene Symbol: RHD
  Gene Name: Rh blood group, D antigen
  Uniprot ID: Q02161
  ENSP ID: ENSP00000350150
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGIFLIWLLDFKQKHPRKTRPVQKQDNFLSLLPAFVREKRS

SEQ ID NO: 73140 - protein, 378 aa, Homo sapiens
  Payload ID: 14489
  Gene Symbol: RHD
  Gene Name: Rh blood group, D antigen
  Uniprot ID: Q02161
  ENSP ID: ENSP00000396420
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPDWLPGPPQHWGTQLGHRDSSHVWSPDSFLIWLLDFKQKHPRKTRPVQKQDNFLSLLPAFVREKRS

SEQ ID NO: 73141 - protein, 431 aa, Homo sapiens
  Payload ID: 14489
  Gene Symbol: RHD
  Gene Name: Rh blood group, D antigen
  ENSP ID: ENSP00000399640
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMSLGWNLAVKMAEAGDEELMRLDVSQRNHGGAAVPTGSWMPSTETTIAPNYRDHISVGLASRSSSALGNSAWPS

SEQ ID NO: 73142 - protein, 321 aa, Homo sapiens
  Payload ID: 14489
  Gene Symbol: RHD
  Gene Name: Rh blood group, D antigen
  Uniprot ID: Q02161
  ENSP ID: ENSP00000413849
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPFPHLAVGF

SEQ ID NO: 73143 - protein, 463 aa, Homo sapiens
  Payload ID: 14489
  Gene Symbol: RHD
  Gene Name: Rh blood group, D antigen
  ENSP ID: ENSP00000456966
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMIGFQVLLSIGELSLAIVIALMSGLLTVSSFGCWILSKSIQEKQGLFKNKTTSSHCCLHLYVRNAHDSKVSNVRAGTGVRENGVESFLCHSLRRISPFIMHCRIQQ

SEQ ID NO: 73144 - protein, 431 aa, Homo sapiens; identical to SEQ ID NO: 73141
  Payload ID: 14489
  Gene Symbol: RHD
  Gene Name: Rh blood group, D antigen
  ENSP ID: ENSP00000478087

SEQ ID NO: 73145 - protein, 302 aa, Homo sapiens
  Payload ID: 14489
  Gene Symbol: RHD
  Gene Name: Rh blood group, D antigen
  ENSP ID: ENSP00000480925
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAG

SEQ ID NO: 73146 - protein, 97 aa, Homo sapiens
  Payload ID: 14490
  Gene Symbol: RHBG
  Gene Name: Rh family, B glycoprotein (gene/pseudogene)
  ENSP ID: ENSP00000389836
MAGSPSRAAGRRLQLPLLCLFLQGATAVLFAVFVRYNHKTDAALWHRSNHSNADNEFYFRYPNGVSLLLPRLECNGTISAHHNLCLPGSSDSPASVS

SEQ ID NO: 73147 - protein, 458 aa, Homo sapiens
  Payload ID: 14490
  Gene Symbol: RHBG
  Gene Name: Rh family, B glycoprotein (gene/pseudogene)
  Uniprot ID: Q9H310
  ENSP ID: ENSP00000441197
MAGSPSRAAGRRLQLPLLCLFLQGATAVLFAVFVRYNHKTDAALWHRSNHSNADNEFYFRYPSFQDVHAMVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDSPPDSQHYEDQVHWQVPGEHEDKAQRPLRVEEADTQA

SEQ ID NO: 73148 - protein, 153 aa, Homo sapiens
  Payload ID: 14490
  Gene Symbol: RHBG
  Gene Name: Rh family, B glycoprotein (gene/pseudogene)
  ENSP ID: ENSP00000477836
MAGSPSRAAGRRLQLPLLCLFLQGATAVLFAVFVRYNHKTDAALWHRSNHSNADNEFYFRYPKESHSVAQAGVQRRNLGSLQPSPPRLPGRACHGLRGLWLPHGLPAALRLQQRGLHLPPGRLCPAVVHTGPGLSPLLPRWPHPCWRGEHDQC

SEQ ID NO: 73149 - protein, 97 aa, Homo sapiens
  Payload ID: 14490
  Gene Symbol: RHBG
  Gene Name: Rh family, B glycoprotein (gene/pseudogene)
  ENSP ID: ENSP00000478851
  MOD_RES (1)..(1): Any amino acid
XAGSPSRAAGRRLQLPLLCLFLQGATAVLFAVFVRYNHKTDAALWHRSNHSNADNEFYFRYPNGVSLLLPRLECNGTISAHHNLCLPGSSDSPASVS

SEQ ID NO: 73150 - protein, 97 aa, Homo sapiens; identical to SEQ ID NO: 73146
  Payload ID: 14490
  Gene Symbol: RHBG
  Gene Name: Rh family, B glycoprotein (gene/pseudogene)
  ENSP ID: ENSP00000483178

SEQ ID NO: 73151 - protein, 479 aa, Homo sapiens
  Payload ID: 14491
  Gene Symbol: RHCG
  Gene Name: Rh family, C glycoprotein
  Uniprot ID: Q9UBD6
  ENSP ID: ENSP00000268122
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 73152 - protein, 233 aa, Homo sapiens
  Payload ID: 14491
  Gene Symbol: RHCG
  Gene Name: Rh family, C glycoprotein
  ENSP ID: ENSP00000452899
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQAPSSCGCTGPASTQPYPTMGTASTEPPSTPTAPWQPACLPRWQYPVPCTRRASWTWCTSRMPRSQEGWPWVPLLR

SEQ ID NO: 73153 - protein, 237 aa, Homo sapiens
  Payload ID: 14491
  Gene Symbol: RHCG
  Gene Name: Rh family, C glycoprotein
  ENSP ID: ENSP00000453496
  MOD_RES (1)..(1): Any amino acid
XDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 73154 - protein, 331 aa, Homo sapiens
  Payload ID: 14491
  Gene Symbol: RHCG
  Gene Name: Rh family, C glycoprotein
  ENSP ID: ENSP00000453588
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTAASWVL

SEQ ID NO: 73155 - protein, 136 aa, Homo sapiens
  Payload ID: 14491
  Gene Symbol: RHCG
  Gene Name: Rh family, C glycoprotein
  ENSP ID: ENSP00000453716
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENDSPGWESSKCHT

SEQ ID NO: 73156 - protein, 410 aa, Homo sapiens [sequence omitted]

SEQ ID NO: 73157 - protein, 409 aa, Homo sapiens
  Payload ID: 14492
  Gene Symbol: RHAG
  Gene Name: Rh-associated glycoprotein
  Uniprot ID: Q02094
  ENSP ID: ENSP00000360217
MRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTPLFTTKLRIHDTCGVHNLHGLPGVVGGLAGIVAVAMGASNTSMAMQAAALGSSIGTAVVGGLMTGLILKLPLWGQPSDQNCYDDSVYWKVPKTR

SEQ ID NO: 73158 - protein, 381 aa, Homo sapiens [sequence omitted]

SEQ ID NO: 73159 - protein, 232 aa, Homo sapiens
  Payload ID: 14493
  Gene Symbol: RND1
  Gene Name: Rho family GTPase 1
  Uniprot ID: Q92730
  ENSP ID: ENSP00000308461
MKERRAPQPVVARCKLVLVGDVQCGKTAMLQVLAKDCYPETYVPTVFENYTACLETEEQRVELSLWDTSGSPYYDNVRPLCYSDSDAVLLCFDISRPETVDSALKKWRTEILDYCPSTRVLLIGCKTDLRTDLSTLMELSHQKQAPISYEQGCAIAKQLGAEIYLEGSAFTSEKSIHSIFRTASMLCLNKPSPLPQKSPVRSLSKRLLHLPSRSELISSTFKKEKAKSCSIM

SEQ ID NO: 73160 - protein, 126 aa, Homo sapiens
  Payload ID: 14493
  Gene Symbol: RND1
  Gene Name: Rho family GTPase 1
  ENSP ID: ENSP00000447059
WRTEILDYCPSTRVLLIGCKTDLRTDLSTLMELSHQKQAPISYEQGCAIAKQLGAEIYLEGSAFTSEKSIHSIFRTASMLCLNKPSPLPQKSPVRSLSKRLLHLPSRSELISSTFKKEKAKSCSIM

SEQ ID NO: 73161 - protein, 96 aa, Homo sapiens
  Payload ID: 14493
  Gene Symbol: RND1
  Gene Name: Rho family GTPase 1
  ENSP ID: ENSP00000449045
MKERRAPQPVVARCKLVLVGDVQCGKTAMLQVLAKDCYPEVSCPPARWPAFLPACPPWGRFPPAQETWLPQPQPILSRFLRLYHPQLLFGWRTALP

SEQ ID NO: 73162 - protein, 227 aa, Homo sapiens
  Payload ID: 14494
  Gene Symbol: RND2
  Gene Name: Rho family GTPase 2
  Uniprot ID: P52198
  ENSP ID: ENSP00000466680
MEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQGTVLAKQVGAVSYVECSSRSSERSVRDVFHVATVASLGRGHRQLRRTDSRRGMQRSAQLSGRPDRGNEGEIHKDRAKSCNLM

SEQ ID NO: 73163 - protein, 244 aa, Homo sapiens
  Payload ID: 14495
  Gene Symbol: RND3
  Gene Name: Rho family GTPase 3
  Uniprot ID: P61587
  ENSP ID: ENSP00000263895
MKERRASQKLSSKSIMDPNQNVKCKIVVVGDSQCGKTALLHVFAKDCFPENYVPTVFENYTASFEIDTQRIELSLWDTSGSPYYDNVRPLSYPDSDAVLICFDISRPETLDSVLKKWKGEIQEFCPNTKMLLVGCKSDLRTDVSTLVELSNHRQTPVSYDQGANMAKQIGAATYIECSALQSENSVRDIFHVATLACVNKTNKNVKRNKSQRATKRISHMPSRPELSAVATDLRKDKAKSCTVM

SEQ ID NO: 73164 - protein, 244 aa, Homo sapiens; identical to SEQ ID NO: 73163
  Payload ID: 14495
  Gene Symbol: RND3
  Gene Name: Rho family GTPase 3
  Uniprot ID: P61587
  ENSP ID: ENSP00000364886

SEQ ID NO: 73165 - protein, 115 aa, Homo sapiens
  Payload ID: 14495
  Gene Symbol: RND3
  Gene Name: Rho family GTPase 3
  ENSP ID: ENSP00000386576
MLLVGCKSDLRTDVSTLVELSNHRQTPVSYDQGANMAKQIGAATYIECSALQSENSVRDIFHVATLACVNKTNKNVKRNKSQRATKRISHMPSRPELSAVATDLRKDKAKSCTVM

SEQ ID NO: 73166 - protein, 116 aa, Homo sapiens
  Payload ID: 14495
  Gene Symbol: RND3
  Gene Name: Rho family GTPase 3
  ENSP ID: ENSP00000395997
MKERRASQKLSSKSIMDPNQNVKCKIVVVGDSQCGKTALLHVFAKDCFPENYVPTVFENYTASFEIDTQRIELSLWDTSGSPYYDNVRPLSYPDSDAVLICFDISRPETLDSVLKK

SEQ ID NO: 73167 - protein, 116 aa, Homo sapiens; identical to SEQ ID NO: 73166
  Payload ID: 14495
  Gene Symbol: RND3
  Gene Name: Rho family GTPase 3
  ENSP ID: ENSP00000411950

SEQ ID NO: 73168 - protein, 204 aa, Homo sapiens
  Payload ID: 14496
  Gene Symbol: ARHGDIA
  Gene Name: Rho GDP dissociation inhibitor (GDI) alpha
  Uniprot ID: P52565
  ENSP ID: ENSP00000269321
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMVGSYGPRAEEYEFLTPVEEAPKGMLARGSYSIKSRFTDDDKTDHLSWEWNLTIKKDWKD

SEQ ID NO: 73169 - protein, 160 aa, Homo sapiens
  Payload ID: 14496
  Gene Symbol: ARHGDIA
  Gene Name: Rho GDP dissociation inhibitor (GDI) alpha
  Uniprot ID: P52565
  ENSP ID: ENSP00000383556
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKNDDKTDHLSWEWNLTIKKDWKD

SEQ ID NO: 73170 - protein, 204 aa, Homo sapiens; identical to SEQ ID NO: 73168
  Payload ID: 14496
  Gene Symbol: ARHGDIA
  Gene Name: Rho GDP dissociation inhibitor (GDI) alpha
  Uniprot ID: P52565
  ENSP ID: ENSP00000441348

SEQ ID NO: 73171 - protein, 129 aa, Homo sapiens
  Payload ID: 14496
  Gene Symbol: ARHGDIA
  Gene Name: Rho GDP dissociation inhibitor (GDI) alpha
  ENSP ID: ENSP00000461956
MAEQEPTAEQLAQIAAENEEDEHSVNYKPPAQKSIQEIQELDKDDESLRKYKEALLGRVAVSAVDKTDYMVGSYGPRAEEYEFLTPVEEAPKGMLARGSYSIKSRFTDDDKTDHLSWEWNLTIKKDWKD

SEQ ID NO: 73172 - protein, 249 aa, Homo sapiens
  Payload ID: 14496
  Gene Symbol: ARHGDIA
  Gene Name: Rho GDP dissociation inhibitor (GDI) alpha
  ENSP ID: ENSP00000462209
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMTTTRPTTCPGSGISPSRRTGRTEPSQRRAGQTDGRTTDRRMCPPQPLPSPYQSADRPSVPLPPWSASLAWLNRVPPTPLLSPPPPTGPASSVSCLVAASACAVG

SEQ ID NO: 73173 - protein, 92 aa, Homo sapiens
  Payload ID: 14496
  Gene Symbol: ARHGDIA
  Gene Name: Rho GDP dissociation inhibitor (GDI) alpha
  ENSP ID: ENSP00000462323
MAEQEPTAEQLAQIAAENEEDEHSVNYKPPAQKSIQEIQELDKDDESLRKYKEALLGRVAVSADPNVPNVVVTGLTLVCSSAPGPLELDLTG

SEQ ID NO: 73174 - protein, 193 aa, Homo sapiens
  Payload ID: 14496
  Gene Symbol: ARHGDIA
  Gene Name: Rho GDP dissociation inhibitor (GDI) alpha
  ENSP ID: ENSP00000462960
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMVGSYGPRAEEYEFLTPVEEAPKGSISPSHPRPGFRRERSSHSPGPVVA

SEQ ID NO: 73175 - protein, 92 aa, Homo sapiens; identical to SEQ ID NO: 73173
  Payload ID: 14496
  Gene Symbol: ARHGDIA
  Gene Name: Rho GDP dissociation inhibitor (GDI) alpha
  ENSP ID: ENSP00000463530

SEQ ID NO: 73176 - protein, 235 aa, Homo sapiens
  Payload ID: 14496
  Gene Symbol: ARHGDIA
  Gene Name: Rho GDP dissociation inhibitor (GDI) alpha
  ENSP ID: ENSP00000463939
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMVGSYGPRAEEYEFLTPVEEAPKGSISPSHPRPGFRRERSSHSPGPVVAPGRVRLLLRGGAGVWDARPRGGRAVLQPRCSLASPLVAVGPV

SEQ ID NO: 73177 - protein, 204 aa, Homo sapiens; identical to SEQ ID NO: 73168
  Payload ID: 14496
  Gene Symbol: ARHGDIA
  Gene Name: Rho GDP dissociation inhibitor (GDI) alpha
  Uniprot ID: P52565
  ENSP ID: ENSP00000464205

SEQ ID NO: 73178 - protein, 201 aa, Homo sapiens
  Payload ID: 14497
  Gene Symbol: ARHGDIB
  Gene Name: Rho GDP dissociation inhibitor (GDI) beta
  Uniprot ID: P52566
  ENSP ID: ENSP00000228945
MTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVSGLKYVQHTYRTGVKVDKATFMVGSYGPRPEEYEFLTPVEEAPKGMLARGTYHNKSFFTDDDKQDHLSWEWNLSIKKEWTE

SEQ ID NO: 73179 - protein, 112 aa, Homo sapiens
  Payload ID: 14497
  Gene Symbol: ARHGDIB
  Gene Name: Rho GDP dissociation inhibitor (GDI) beta
  ENSP ID: ENSP00000437454
MTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIH

SEQ ID NO: 73180 - protein, 201 aa, Homo sapiens; identical to SEQ ID NO: 73178
  Payload ID: 14497
  Gene Symbol: ARHGDIB
  Gene Name: Rho GDP dissociation inhibitor (GDI) beta
  Uniprot ID: P52566
  ENSP ID: ENSP00000440560

SEQ ID NO: 73181 - protein, 201 aa, Homo sapiens; identical to SEQ ID NO: 73178
  Payload ID: 14497
  Gene Symbol: ARHGDIB
  Gene Name: Rho GDP dissociation inhibitor (GDI) beta
  Uniprot ID: P52566
  ENSP ID: ENSP00000444860

SEQ ID NO: 73182 - protein, 195 aa, Homo sapiens
  Payload ID: 14497
  Gene Symbol: ARHGDIB
  Gene Name: Rho GDP dissociation inhibitor (GDI) beta
  ENSP ID: ENSP00000445185
  MOD_RES (1)..(1): Any amino acid
XEPHVEEDDDDELDSKLNYKPPPQKSLKELQEMDKDDESLIKYKKTLLGDGPVVTDPKAPNVVVTRLTLVCESAPGPITMDLTDLEALKKETIVLKEGSEYRVKIHFKVNRDIVSGLKYVQHTYRTGVKVDKATFMVGSYGPRPEEYEFLTPVEEAPKGMLARGTYHNKSFFTDDDKQDHLSWEWNLSIKKEWTE

SEQ ID NO: 73183 - protein, 158 aa, Homo sapiens
  Payload ID: 14497
  Gene Symbol: ARHGDIB
  Gene Name: Rho GDP dissociation inhibitor (GDI) beta
  ENSP ID: ENSP00000445263
MTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVSGLKYVQHTYRTGVKVDKATFMVGSYGPRPEEYEFLTP

SEQ ID NO: 73184 - protein, 88 aa, Homo sapiens
  Payload ID: 14497
  Gene Symbol: ARHGDIB
  Gene Name: Rho GDP dissociation inhibitor (GDI) beta
  ENSP ID: ENSP00000445450
MTEKAPEPHVEEDDDDELDSKLNYKPPPQKSLKELQEMDKDDESLIKYKKTLLGDGPVVTDPKAPNVVVTRLTLVCESAPGPITMDLT

SEQ ID NO: 73185 - protein, 225 aa, Homo sapiens
  Payload ID: 14498
  Gene Symbol: ARHGDIG
  Gene Name: Rho GDP dissociation inhibitor (GDI) gamma
  Uniprot ID: Q99819
  ENSP ID: ENSP00000219409
MLGLDACELGAQLLELLRLALCARVLLADKEGGPPAVDEVLDEAVPEYRAPGRKSLLEIRQLDPDDRSLAKYKRVLLGPLPPAVDPSLPNVQVTRLTLLSEQAPGPVVMDLTGDLAVLKDQVFVLKEGVDYRVKISFKVHREIVSGLKCLHHTYRRGLRVDKTVYMVGSYGPSAQEYEFVTPVEEAPRGALVRGPYLVVSLFTDDDRTHHLSWEWGLCICQDWKD

SEQ ID NO: 73186 - protein, 136 aa, Homo sapiens
  Payload ID: 14498
  Gene Symbol: ARHGDIG
  Gene Name: Rho GDP dissociation inhibitor (GDI) gamma
  ENSP ID: ENSP00000397395
MSASCDGCVGSRPPVHLASGYSLADLLVLEMGMGTQCWTEDQRRWSSLWPWSHLSSVLLADKEGGPPAVDEVLDEAVPEYRAPGRKSLLEIRQLDPDDRSLAKYKRVLLGPLPPAVDPSLPNVQVTRLTLLSEQAP

SEQ ID NO: 73187 - protein, 178 aa, Homo sapiens
  Payload ID: 14498
  Gene Symbol: ARHGDIG
  Gene Name: Rho GDP dissociation inhibitor (GDI) gamma
  ENSP ID: ENSP00000404435
MLGLDACELGAQLLELLRLALCARVLLADKEGGPPAVDEVLDEAVPEYRAPGRKSLLEIRQLDPDDRSLAKYKRVLLGPLPPAVDPSLPNVQVTRLTLLSEQAPGPVVMDLTGDLAVLKDQVFVLKEGVDYRVHREIVSGLKCLHHTYRRGLRVDKTVYMVGSYGPSAQEYEFVTPVE

SEQ ID NO: 73188 - protein, 76 aa, Homo sapiens
  Payload ID: 14498
  Gene Symbol: ARHGDIG
  Gene Name: Rho GDP dissociation inhibitor (GDI) gamma
  ENSP ID: ENSP00000408037
MSASCDGCVGSRPPVHLASGYSLADLLVLEMGMGTQCWTEDQRRWSSLWPWSHLSSDPSLPNVQVTRLTLLSEQAP

SEQ ID NO: 73189 - protein, 116 aa, Homo sapiens
  Payload ID: 14498
  Gene Symbol: ARHGDIG
  Gene Name: Rho GDP dissociation inhibitor (GDI) gamma
  ENSP ID: ENSP00000410541
MDLTGDLAVLKDQVFVLKEGVDYRVKISFKVHREIVSGLKCLHHTYRRGLRVDKTVYMVGSYGPSAQEYEFVTPVEEAPRGALVRGPYLVVSLFTDDDRTHHLSWEWGLCICQDWK

SEQ ID NO: 73190 - protein, 439 aa, Homo sapiens
  Payload ID: 14499
  Gene Symbol: ARHGAP1
  Gene Name: Rho GTPase activating protein 1
  Uniprot ID: Q07960
  ENSP ID: ENSP00000310491
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPSLSWLRDAYREFDRKYKKNIKALYIVHPTMFIKTLLILFKPLISFKFGQKIFYVNYLSELSEHVKLEQLGIPRQVLKYDDFLKSTQKSPATAPKPMPPRPPLPNQQFGVSLQHLQEKNPEQEPIPIVLRETVAYLQAHALTTEGIFRRSANTQVVREVQQKYNMGLPVDFDQYNELHLPAVILKTFLRELPEPLLTFDLYPHVVGFLNIDESQRVPATLQVLQTLPEENYQVLRFLTAFLVQISAHSDQNKMTNTNLAVVFGPNLLWAKDAAITLKAINPINTFTKFLLDHQGELFPSPDPSGL

SEQ ID NO: 73191 - protein, 192 aa, Homo sapiens
  Payload ID: 14499
  Gene Symbol: ARHGAP1
  Gene Name: Rho GTPase activating protein 1
  ENSP ID: ENSP00000432794
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPSLSWLRDAYREFDRKYKKNIKALYIVHPTMFIKTLLILFKPLISFKFGQKIFYVNYL

SEQ ID NO: 73192 - protein, 334 aa, Homo sapiens
  Payload ID: 14499
  Gene Symbol: ARHGAP1
  Gene Name: Rho GTPase activating protein 1
  ENSP ID: ENSP00000434883
  MOD_RES (1)..(1): Any amino acid
XLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYKKNIKALYIVHPTMFIKTLLILFKPLISFKFGQKIFYVNYLSELSEHVKLEQLGIPRQVLKYDDFLKSTQKSPATAPKPMPPRPPLPNQQFGVSLQHLQEKNPEQEPIPIVLRETVAYLQAHALTTEGIFRRSANTQVVREVQQKYNMGLPVDFDQYNELHLPAVILKTFLRELPEPLLTFDLYPHVVGFLNIDESQRVPATLQVLQTLPEENYQVLRFLTAFLVQISA

SEQ ID NO: 73193 - protein, 786 aa, Homo sapiens
  Payload ID: 14500
  Gene Symbol: ARHGAP10
  Gene Name: Rho GTPase activating protein 10
  Uniprot ID: A1A4S6
  ENSP ID: ENSP00000336923
MGLQPLEFSDCYLDSPWFRERIRAHEAELERTNKFIKELIKDGKNLIAATKSLSVAQRKFAHSLRDFKFEFIGDAVTDDERCIDASLREFSNFLKNLEEQREIMALSVTETLIKPLEKFRKEQLGAVKEEKKKFDKETEKNYSLIDKHLNLSAKKKDSHLQEADIQVEQNRQHFYELSLEYVCKLQEIQERKKFEFVEPMLSFFQGMFTFYHQGHELAKDFNHYKMELQINIQNTRNRFEGTRSEVEELMNKIRQNPKDHKRASQFTAEGYLYVQEKRPAPFGSSWVKHYCMYRKAAKKFNMIPFEHRSGGKLGDGEVFFLKECTKRHTDSIDRRFCFDIEAADRPGVSLTMQAFSEEERKQWLEALGGKEALSHSFNTAIIPRPEGNAQLDKMGFTIIRKCISAVETRGINDQGLYRVVGVSSKVQRLLSMLMDVKTCNEVDLENSADWEVKTITSALKQYLRSLPEPLMTYELHGDFIVPAKSGSPESRVNAIHFLVHKLPEKNKEMLDILVKHLTNVSNHSKQNLMTVANLGVVFGPTLMRPQEETVAALMDLKFQNIVVEILIENHEKIFRTPPDTTFPEPTCLSASPPNAPPRQSKRQGQRTKRPVAVYNLCLELEDGDNPYPSKEDTPTSSLDSLSSPSPVTTAVPGPPGPDKNHLLADGGSFGDWASTIPGQTRSSMVQWLNPQSPTTTSSNSAVTPLSPGSSPFPFSPPATVADKPPESIRSRKARAVYPCEAEHSSELSFEIGAIFEDVQTSREPGWLEGTLNGKRGLIPQNYVKLL

SEQ ID NO: 73194 - protein, 413 aa, Homo sapiens
  Payload ID: 14500
  Gene Symbol: ARHGAP10
  Gene Name: Rho GTPase activating protein 10
  ENSP ID: ENSP00000422358
  MOD_RES (1)..(1): Any amino acid
XCTKRHTDSIDRRFCFDIEAADRPGVSLTMQAFSEEERKQWLEALGGKEALSHSFNTAIIPRPEGNAQLDKMGFTIIRKCISAVETRGINDQGLYRVVGVSSKVQRLLSMLMDVKTCNEVDLENSADWEVKTITSALKQYLRSLPEPLMTYELHGDFIVPAKSGSPESRVNAIHFLVHKLPEKNKEMLDILVKHLTNVSNHSKQNLMTVANLGVVFGPTLMRPQEETVAALMDLKFQNIVVEILIENHEKIFRTPPDTTFPEPTCLSASPPNAPPRQSKRQGQRTKRPVAVYNLCLELEDGDNPYPSKEDTPTSSLDSLSSPSPVTTAVPGPPGPDKNHLLADGGSFGDWASTIIRSRKARAVYPCEAEHSSELSFEIGAIFEDVQTSREPGWLEGTLNGKRGLIPQNYVKLL

SEQ ID NO: 73195 - protein, 1023 aa, Homo sapiens
  Payload ID: 14501
  Gene Symbol: ARHGAP11A
  Gene Name: Rho GTPase activating protein 11A
  Uniprot ID: Q6P4F7
  ENSP ID: ENSP00000355090
MWDQRLVRLALLQHLRAFYGIKVKGVRGQCDRRRHETAATEIGGKIFGVPFNALPHSAVPEYGHIPSFLVDACTSLEDHIHTEGLFRKSGSVIRLKALKNKVDHGEGCLSSAPPCDIAGLLKQFFRELPEPILPADLHEALLKAQQLGTEEKNKATLLLSCLLADHTVHVLRYFFNFLRNVSLRSSENKMDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTSKPVDL

SEQ ID NO: 73196 - protein, 834 aa, Homo sapiens
  Payload ID: 14501
  Gene Symbol: ARHGAP11A
  Gene Name: Rho GTPase activating protein 11A
  Uniprot ID: Q6P4F7
  ENSP ID: ENSP00000440073
MDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTGPNNSSFQEVDANEASSMVENLEVENSLEPDIMVEKSPATSCELTPSNLNNKHNSNITSSPLSGDENNMTKETLVKVQKAFSESGSNLHALMNQRQSSVTNVGKVKLTEPSYLEDSPEENLFETNDLTIVESKEKYEHHTGKGEKCFSERDFSPLQTQTFNRETTIKCYSTQMKMEHEKDIHSNMPKDYLSKQEFSSDEEIKKQQSPKDKLNNKLKENENMMEGNLPKCAAHSKDEARSSFSQQSTCVVTNLSKPRPMRIAKQQSLETCEKTVSESSQMTEHRKVSDHIQWFNKLSLNEPNRIKVKSPLKFQRTPVRQSVRRINSLLEYSRQPTGHKLASLGDTASPLVKSVSCDGALSSCIESASKDSSVSCIKSGPKEQKSMSCEESNIGAISKSSMELPSKSFLKMRKHPDSVNASLRSTTVYKQKILSDGQVKVPLDDLTNHDIVKPVVNNNMGISSGINNRVLRRPSERGRAWYKGSPKHPIGKTQLLPTSKPVDL

SEQ ID NO: 73197 - protein, 501 aa, Homo sapiens
  Payload ID: 14501
  Gene Symbol: ARHGAP11A
  Gene Name: Rho GTPase activating protein 11A
  Uniprot ID: Q6P4F7
  ENSP ID: ENSP00000454575
MWDQRLVRLALLQHLRAFYGIKVKGVRGQCDRRRHETAATEIGGKIFGVPFNALPHSAVPEYGHIPSFLVDACTSLEDHIHTEGLFRKSGSVIRLKALKNKVDHGEGCLSSAPPCDIAGLLKQFFRELPEPILPADLHEALLKAQQLGTEEKNKATLLLSCLLADHTVHVLRYFFNFLRNVSLRSSENKMDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSVHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGTFTYYC

SEQ ID NO: 73198 - protein, 207 aa, Homo sapiens
  Payload ID: 14501
  Gene Symbol: ARHGAP11A
  Gene Name: Rho GTPase activating protein 11A
  ENSP ID: ENSP00000455593
  MOD_RES (1)..(1): Any amino acid
XFVSGALNKFKPNRTPSITPQEERIAQLSESPVILTPNAKRTLPVDSSHGFSIHIDTSSEGSSQSSLSPVLIGGNHLITAGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGSEKISKSEETLLTPERLVGTNYRMSWTG

SEQ ID NO: 73199 - protein, 834 aa, Homo sapiens; identical to SEQ ID NO: 73196
  Payload ID: 14501
  Gene Symbol: ARHGAP11A
  Gene Name: Rho GTPase activating protein 11A
  Uniprot ID: Q6P4F7
  ENSP ID: ENSP00000455754

SEQ ID NO: 73200 - protein, 473 aa, Homo sapiens
  Payload ID: 14501
  Gene Symbol: ARHGAP11A
  Gene Name: Rho GTPase activating protein 11A
  ENSP ID: ENSP00000456078
MWDQRLVRLALLQHLRAFYGIKVKGVRGQCDRRRHETAATEIGGKIFGVPFNALPHSAVPEYGHIPSFLVDACTSLEDHIHTEGLFRKSGSVIRLKALKNKVDHGEGCLSSAPPCDIAGLLKQFFRELPEPILPADLHEALLKAQQLGTEEKNKATLLLSCLLADHTVHVLRYFFNFLRNVSLRSSENKMDSSNLAVIFAPNLLQTSEGHEKMSSNTEKKLRLQAAVVQTLIDYASDIGRVPDFILEKIPAMLGIDGLCATPSLEGFEEGEYETPGEYKRKRRQSVGDFVSGALNKFKPNRTPSITPQEERIAQLSESPVILTPNAKRTLPVDSSHGFSSKKRKSIKHNFNFELLPSNLFNSSSTPVSGVPRRSKRIAGKKVCRVESGKAGCFSPKISHKEKVRRSLRLKFNLGKNGREVNGCSGVNRYESVGWRLANQQSLKNRIESVKTGLLFSPDVDEKLPKKGTFTYYC

SEQ ID NO: 73201 - protein, 1023 aa, Homo sapiens; identical to SEQ ID NO: 73195
  Payload ID: 14501
  Gene Symbol: ARHGAP11A
  Gene Name: Rho GTPase activating protein 11A
  Uniprot ID: Q6P4F7
  ENSP ID: ENSP00000479117

SEQ ID NO: 73202 - protein, 834 aa, Homo sapiens; identical to SEQ ID NO: 73196
  Payload ID: 14501
  Gene Symbol: ARHGAP11A
  Gene Name: Rho GTPase activating protein 11A
  Uniprot ID: Q6P4F7
  ENSP ID: ENSP00000480085

SEQ ID NO: 73203 - protein, 834 aa, Homo sapiens; identical to SEQ ID NO: 73196
  Payload ID: 14501
  Gene Symbol: ARHGAP11A
  Gene Name: Rho GTPase activating protein 11A
  Uniprot ID: Q6P4F7
  ENSP ID: ENSP00000481011

SEQ ID NO: 73204 - protein, 1023 aa, Homo sapiens; identical to SEQ ID NO: 73195
  Payload ID: 14501
  Gene Symbol: ARHGAP11A
  Gene Name: Rho GTPase activating protein 11A
  ENSP ID: ENSP00000488640

SEQ ID NO: 73205 - protein, 267 aa, Homo sapiens; identical to SEQ ID NO: 1201
  Payload ID: 14502
  Gene Symbol: ARHGAP11B
  Gene Name: Rho GTPase activating protein 11B
  Uniprot ID: Q3KRB8
  ENSP ID: ENSP00000392760

SEQ ID NO: 73206 - protein, 267 aa, Homo sapiens; identical to SEQ ID NO: 1201
  Payload ID: 14502
  Gene Symbol: ARHGAP11B
  Gene Name: Rho GTPase activating protein 11B
  Uniprot ID: Q3KRB8
  ENSP ID: ENSP00000457054

SEQ ID NO: 73207 - protein, 267 aa, Homo sapiens; identical to SEQ ID NO: 1201
  Payload ID: 14502
  Gene Symbol: ARHGAP11B
  Gene Name: Rho GTPase activating protein 11B
  Uniprot ID: Q3KRB8
  ENSP ID: ENSP00000481934

SEQ ID NO: 73208 - protein, 794 aa, Homo sapiens
  Payload ID: 14503
  Gene Symbol: ARHGAP12
  Gene Name: Rho GTPase activating protein 12
  Uniprot ID: Q8IWW6
  ENSP ID: ENSP00000310984
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQEWLKHVDDQGRQYYYSADGSRSEWELPKYNASSQQQREIIKSRSLDRRLQEPIVLTKWRHSTIVLDTNDKESPTASKPCFPENESSPSSPKHQDTDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 73209 - protein, 846 aa, Homo sapiens
  Payload ID: 14503
  Gene Symbol: ARHGAP12
  Gene Name: Rho GTPase activating protein 12
  Uniprot ID: Q8IWW6
  ENSP ID: ENSP00000345808
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTASSPKDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 73210 - protein, 799 aa, Homo sapiens
  Payload ID: 14503
  Gene Symbol: ARHGAP12
  Gene Name: Rho GTPase activating protein 12
  ENSP ID: ENSP00000364394
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQEWLKHVDDQGRQYYYSADGSRSEWELPKYNASSQQQREIIKSRSLDRRLQEPIVLTKWRHSTIVLDTNDKESPTASKPCFPENESSPSSPKHQDTASSPKDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 73211 - protein, 816 aa, Homo sapiens
  Payload ID: 14503
  Gene Symbol: ARHGAP12
  Gene Name: Rho GTPase activating protein 12
  Uniprot ID: Q8IWW6
  ENSP ID: ENSP00000364399
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 73212 - protein, 841 aa, Homo sapiens
  Payload ID: 14503
  Gene Symbol: ARHGAP12
  Gene Name: Rho GTPase activating protein 12
  Uniprot ID: Q8IWW6
  ENSP ID: ENSP00000379448
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 73213 - protein, 196 aa, Homo sapiens
  Payload ID: 14503
  Gene Symbol: ARHGAP12
  Gene Name: Rho GTPase activating protein 12
  ENSP ID: ENSP00000398050
  MOD_RES (1)..(1): Any amino acid
XSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKESPTASKPCFPENESSPSSPKHQDTDQEKYGLLNVTKIAENGKKVRKNWLSSWAVLQGSSLLFTKTQGSSTSWFGSNQSKPEFTVDLK

SEQ ID NO: 73214 - protein, 475 aa, Homo sapiens
  Payload ID: 14504
  Gene Symbol: ARHGAP15
  Gene Name: Rho GTPase activating protein 15
  Uniprot ID: Q53QZ3
  ENSP ID: ENSP00000295095
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLMFRLHHSASDTSDKNRVKSRLKKFITRRPSLKTLQEKGLIKDQIFGSHLHKVCERENSTVPWFVKQCIEAVEKRGLDVDGIYRVSGNLATIQKLRFIVNQEEKLNLDDSQWEDIHVVTGALKMFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 73215 - protein, 138 aa, Homo sapiens
  Payload ID: 14504
  Gene Symbol: ARHGAP15
  Gene Name: Rho GTPase activating protein 15
  ENSP ID: ENSP00000386560
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMSFCLMCSGGT

SEQ ID NO: 73216 - protein, 56 aa, Homo sapiens
  Payload ID: 14504
  Gene Symbol: ARHGAP15
  Gene Name: Rho GTPase activating protein 15
  ENSP ID: ENSP00000390310
  MOD_RES (1)..(1): Any amino acid
XLDVDGIYRVSGNLATIQKLRFIVNQVVSGIPALLSELDGDLWTPLVSCRFFTVVI

SEQ ID NO: 73217 - protein, 881 aa, Homo sapiens
  Payload ID: 14505
  Gene Symbol: ARHGAP17
  Gene Name: Rho GTPase activating protein 17
  Uniprot ID: Q68EM7
  ENSP ID: ENSP00000289968
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESFGVKLMDFQAHRRGGTLNRKHISPAFQPPLPPTDGSTVVPAGPEPPPQSSRAESSSGGGTVPSSAGILEQGPSPGDGSPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 73218 - protein, 803 aa, Homo sapiens
  Payload ID: 14505
  Gene Symbol: ARHGAP17
  Gene Name: Rho GTPase activating protein 17
  Uniprot ID: Q68EM7
  ENSP ID: ENSP00000303130
MKKQFNRMKQLANQTVGRAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFFVTLLEAQADYHRKALAVLEKTLPEMRAHQDKWAEKPAFGTPLEEHLKRSGREIALPIEACVMLLLETGMKEEGLFRIGAGASKLKKLKAALDCSTSHLDEFYSDPHAVAGALKSYLRELPEPLMTFNLYEEWTQVASVQDQDKKLQDLWRTCQKLPPQNFVNFRYLIKFLAKLAQTSDVNKMTPSNIAIVLGPNLLWARNEGTLAEMAAATSVHVVAVIEPIIQHADWFFPEEVEFNVSEAFVPLTTPSSNHSFHTGNDSDSGTLERKRPASMAVMEGDLVKKESPPKPKDPVSAAVPAPGRNNSQIASGQNQPQAAAGSHQLSMGQPHNAAGPSPHTLRRAVKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDSNSRVSEPHRSIFPEMHSDSASKDVPGRILLDIDNDTESTAL

SEQ ID NO: 73219 - protein, 211 aa, Homo sapiens
  Payload ID: 14505
  Gene Symbol: ARHGAP17
  Gene Name: Rho GTPase activating protein 17
  ENSP ID: ENSP00000406701
MAADVSRNSLQAHDNFLAEKTEVLSEDLLQIERRLDTVRSICHHSHKRLVACFQGQHGTDAERRHKKLPLTALAQNMQEASTQLEDSLLGKMLETCGDAENQLALELSQHEVFVEKEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFF

SEQ ID NO: 73220 - protein, 124 aa, Homo sapiens
  Payload ID: 14505
  Gene Symbol: ARHGAP17
  Gene Name: Rho GTPase activating protein 17
  ENSP ID: ENSP00000459074
MKKQFNRMKQLANQTVGRAEKTEVLSEDLLQIERRLDTVRSICHHSHKRLVACFQGQHGTDAERRHKKLPLTALAQNMQEASTQLEDSLLGCWRRVEMLRISWLSSSPSTKSLLRRRSWTLCTA

SEQ ID NO: 73221 - protein, 95 aa, Homo sapiens
  Payload ID: 14505
  Gene Symbol: ARHGAP17
  Gene Name: Rho GTPase activating protein 17
  ENSP ID: ENSP00000460600
  MOD_RES (1)..(1): Any amino acid
XPPSTPPLGKQNPSLPAPQTLAGGNPETAQPHAGTLPRPRPVPKPRNRPSVPPPPQPPGVHSAGDSSLTNTAPTASKIVTDALPSALTGGEGFQD

SEQ ID NO: 73222 - protein, 235 aa, Homo sapiens
  Payload ID: 14505
  Gene Symbol: ARHGAP17
  Gene Name: Rho GTPase activating protein 17
  ENSP ID: ENSP00000460985
  MOD_RES (1)..(1): Any amino acid
XKKPAPAPPKPGNPPPGHPGGQSSSGTSQHPPSLSPKPPTRSPSPPTQHTGQPPGQPSAPSQLSAPRRYSSSLSPIQAPNHPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTGFQNRIAASFLKCTQTQPAKTCLAASCWI

SEQ ID NO: 73223 - protein, 71 aa, Homo sapiens
  Payload ID: 14505
  Gene Symbol: ARHGAP17
  Gene Name: Rho GTPase activating protein 17
  ENSP ID: ENSP00000461411
MKKQFNRMKQLANQTVGRAEKTEVLSEDLLQIERRLDTVRSICHHSHKRLVACFQGQHGTDAERRHVFNLL

SEQ ID NO: 73224 - protein, 76 aa, Homo sapiens
  Payload ID: 14505
  Gene Symbol: ARHGAP17
  Gene Name: Rho GTPase activating protein 17
  ENSP ID: ENSP00000461426
MQEASTQLEDSLLGKMLETCGDAENQLALELSQHEVFVEKEIVDPLYGIAEVEIPNIQKQRKQLARLVLDWDSVRA

SEQ ID NO: 73225 - protein, 128 aa, Homo sapiens
  Payload ID: 14505
  Gene Symbol: ARHGAP17
  Gene Name: Rho GTPase activating protein 17
  ENSP ID: ENSP00000461639
  MOD_RES (1)..(1): Any amino acid
XPPPQPPTQATPLMHTKPNSQGPPNPMALPSEHGLEQPSHTPPQTPTPPSTPPLGKQNPSLPAPQTLAGGNPETAQPHAGTLPRPRPVPKPRNRPSVPPPPQPPGVHSAGDSSLTNTAPTASKIVTDV

SEQ ID NO: 73226 - protein, 663 aa, Homo sapiens
  Payload ID: 14506
  Gene Symbol: ARHGAP18
  Gene Name: Rho GTPase activating protein 18
  Uniprot ID: Q8N392
  ENSP ID: ENSP00000357131
MSWLSSSQGVVLTAYHPSGKDQTVGNSHAKAGEEATSSRRYGQYTMNQESTTIKVMEKPPFDRSISQDSLDELSMEDYWIELENIKKSSENSQEDQEVVVVKEPDEGELEEEWLKEAGLSNLFGESAGDPQESIVFLSTLTRTQAAAVQKRVETVSQTLRKKNKQYQIPDVRDIFAQQRESKETAPGGTESQSLRTNENKYQGRDDEASNLVGEEKLIPPEETPAPETDINLEVSFAEQALNQKESSKEKIQKSKGDDATLPSFRLPKDKTGTTRIGDLAPQDMKKVCHLALIELTALYDVLGIELKQQKAVKIKTKDSGLFCVPLTALLEQDQRKVPGMRIPLIFQKLISRIEERGLETEGLLRIPGAAIRIKNLCQELEAKFYEGTFNWESVKQHDAASLLKLFIRELPQPLLSVEYLKAFQAVQNLPTKKQQLQALNLLVILLPDANRDTLKALLEFLQRVIDNKEKNKMTVMNVAMVMAPNLFMCHALGLKSSEQREFVMAAGTANTMHLLIKYQKLLWTIPKFIVNQVRKQNTENHKKDKRAMKKLLKKMAYDREKYEKQDKSTNDADVPQGVIRVQAPHLSKVSMAIQLTEELKASDVLARFLSQESGVAQTLKKGEVFLYEIGGNIGERCLDDDTYMKDLYQLNPNAEWVIKSKPL

SEQ ID NO: 73227 - protein, 465 aa, Homo sapiens
  Payload ID: 14507
  Gene Symbol: ARHGAP19
  Gene Name: Rho GTPase activating protein 19
  Uniprot ID: Q14CB8
  ENSP ID: ENSP00000351058
MATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 73228 - protein, 494 aa, Homo sapiens
  Payload ID: 14507
  Gene Symbol: ARHGAP19
  Gene Name: Rho GTPase activating protein 19
  Uniprot ID: Q14CB8
  ENSP ID: ENSP00000351333
MATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 73229 - protein, 485 aa, Homo sapiens
  Payload ID: 14507
  Gene Symbol: ARHGAP19
  Gene Name: Rho GTPase activating protein 19
  Uniprot ID: Q14CB8
  ENSP ID: ENSP00000360066
MPHQKLSALIDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 73230 - protein, 300 aa, Homo sapiens
  Payload ID: 14507
  Gene Symbol: ARHGAP19
  Gene Name: Rho GTPase activating protein 19
  ENSP ID: ENSP00000473327
  MOD_RES (1)..(1): Any amino acid
XTEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNGLVLLPTLEESNTITTHCSLI

SEQ ID NO: 73231 - protein, 197 aa, Homo sapiens
  Payload ID: 14507
  Gene Symbol: ARHGAP19
  Gene Name: Rho GTPase activating protein 19
  ENSP ID: ENSP00000473667
MATEAQSEGEVPARESGRSDAICSFVICNDSSLREKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALM

SEQ ID NO: 73232 - protein, 1191 aa, Homo sapiens
  Payload ID: 14508
  Gene Symbol: ARHGAP20
  Gene Name: Rho GTPase activating protein 20
  Uniprot ID: Q9P2F6
  ENSP ID: ENSP00000260283
MEAMSPQQETLGGQPGRSSSLTGVSRLAGGSCTKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 73233 - protein, 1155 aa, Homo sapiens
  Payload ID: 14508
  Gene Symbol: ARHGAP20
  Gene Name: Rho GTPase activating protein 20
  Uniprot ID: Q9P2F6
  ENSP ID: ENSP00000431399
MKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 73234 - protein, 1168 aa, Homo sapiens
  Payload ID: 14508
  Gene Symbol: ARHGAP20
  Gene Name: Rho GTPase activating protein 20
  Uniprot ID: Q9P2F6
  ENSP ID: ENSP00000432076
MSARERQPALKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 73235 - protein, 1155 aa, Homo sapiens; identical to SEQ ID NO: 73233
  Payload ID: 14508
  Gene Symbol: ARHGAP20
  Gene Name: Rho GTPase activating protein 20
  Uniprot ID: Q9P2F6
  ENSP ID: ENSP00000436319

SEQ ID NO: 73236 - protein, 1165 aa, Homo sapiens
  Payload ID: 14508
  Gene Symbol: ARHGAP20
  Gene Name: Rho GTPase activating protein 20
  Uniprot ID: Q9P2F6
  ENSP ID: ENSP00000436522
MTFWIIINKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 73237 - protein, 731 aa, Homo sapiens
  Payload ID: 14508
  Gene Symbol: ARHGAP20
  Gene Name: Rho GTPase activating protein 20
  ENSP ID: ENSP00000437905
MDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRNCC

SEQ ID NO: 73238 - protein, 1165 aa, Homo sapiens
  Payload ID: 14509
  Gene Symbol: ARHGAP21
  Gene Name: Rho GTPase activating protein 21
  ENSP ID: ENSP00000365592
MMATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRVGDTSPPDFLKSLIQF

SEQ ID NO: 73239 - protein, 1407 aa, Homo sapiens
  Payload ID: 14509
  Gene Symbol: ARHGAP21
  Gene Name: Rho GTPase activating protein 21
  Uniprot ID: Q5T5U3
  ENSP ID: ENSP00000365604
MATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSHWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGSKAEFHPCL

SEQ ID NO: 73240 - protein, 1958 aa, Homo sapiens
  Payload ID: 14509
  Gene Symbol: ARHGAP21
  Gene Name: Rho GTPase activating protein 21
  Uniprot ID: Q5T5U3
  ENSP ID: ENSP00000379709
MMATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVLQFTKDVTALAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGSKAEFHPCL

SEQ ID NO: 73241 - protein, 197 aa, Homo sapiens
  Payload ID: 14509
  Gene Symbol: ARHGAP21
  Gene Name: Rho GTPase activating protein 21
  ENSP ID: ENSP00000389940
  MOD_RES (1)..(1): Any amino acid
XNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLIQLLVTQQNLRVLGDLERISIAGNCLCPPSLQLLV

SEQ ID NO: 73242 - protein, 179 aa, Homo sapiens
  Payload ID: 14509
  Gene Symbol: ARHGAP21
  Gene Name: Rho GTPase activating protein 21
  ENSP ID: ENSP00000400566
GDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVNLEFSTFYKNTIAKFLQLSDMEMLC

SEQ ID NO: 73243 - protein, 113 aa, Homo sapiens
  Payload ID: 14509
  Gene Symbol: ARHGAP21
  Gene Name: Rho GTPase activating protein 21
  ENSP ID: ENSP00000402761
YIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLFLSAHLKTVA

SEQ ID NO: 73244 - protein, 1131 aa, Homo sapiens
  Payload ID: 14509
  Gene Symbol: ARHGAP21
  Gene Name: Rho GTPase activating protein 21
  ENSP ID: ENSP00000405018
MMATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVLQFTKDVTALAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIM

SEQ ID NO: 73245 - protein, 1406 aa, Homo sapiens
  Payload ID: 14509
  Gene Symbol: ARHGAP21
  Gene Name: Rho GTPase activating protein 21
  ENSP ID: ENSP00000480005
MATRRTGLSEGDGDKLKACEVSKNKDGKEQSETVSLSEDETFSWPGPKTVTLKRTSQGFGFTLRHFIVYPPESAIQFSYKDEENGNRGGKQRNRLEPMDTIFVKQVKEGGPAFEAGLCTGDRIIKVNGESVIGKTYSQVIALIQNSDTTLELSVMPKDEDILQVAYSQDAYLKGNEAYSGNARNIPEPPPICYPWLPSAPSAMAQPVEISPPDSSLSKQQTSTPVLTQPGRAYRMEIQVPPSPTDVAKSNTAVCVCNESVRTVIVPSEKVVDLLSNRNNHTGPSHRTEEVRYGVSEQTSLKTVSRTTSPPLSIPTTHLIHQPAGSRSLEPSGILLKSGNYSGHSDGISSSRSQAVEAPSVSVNHYSPNSHQHIDWKNYKTYKEYIDNRRLHIGCRTIQERLDSLRAASQSTTDYNQVVPNRTTLQGRRRSTSHDRVPQSVQIRQRSVSQERLEDSVLMKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFSSIPSIMRKTFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTVAENSEKNKMEPRNLAIVFGPTLVRTSEDNMTHMVTHMPDQYKIVETLIQHHDWFFTEEGAEEPLTTVQEESTVDSQPVPNIDHLLTNIGRTGVSPGDVSDSATSDSTKSKGSWGSGKDQYSRELLVSSIFAAASRKRKKPKEKAQPSSSEDELDNVFFKKENVEQCHNDTKEESKKESETLGRKQKIIIAKENSTRKDPSTTKDEKISLGKESTPSEEPSPPHNSKHNKSPTLSCRFAILKESPRSLLAQKSSHLEETGSDSGTLLSTSSQASLARFSMKKSTSPETKHSEFLANVSTITSDYSTTSSATYLTSLDSSRLSPEVQSVAESKGDEADDERSELISEGRPVETDSESEFPVFPTALTSERLFRGKLQEVTKSSRRNSEGSELSCTEGSLTSSLDSRRQLFSSHKLIECDTLSRKKSARFKSDSGSLGDAKNEKEAPSLTKVFDVMKKGKSTGSLLTPTRGESEKQEPTWKTKIADRLKLRPRAPADDMFGVGNHKVNAETAKRKSIRRRHTLGGHRDATEISVLNFWKVHEQSGERESELSAVNRLKPKCSAQDLSISDWLARERLRTSTSDLSRGEIGDPQTENPSTREIATTDTPLSLHCNTGSSSSTLASTNRPLLSIPPQSPDQINGESFQNVSKNASSAANAQPHKLSETPGSKAEFHPCL

SEQ ID NO: 73246 - protein, 698 aa, Homo sapiens
  Payload ID: 14510
  Gene Symbol: ARHGAP22
  Gene Name: Rho GTPase activating protein 22
  Uniprot ID: Q7Z5H3
  ENSP ID: ENSP00000249601
MLSPKIRQARRARSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 73247 - protein, 539 aa, Homo sapiens
  Payload ID: 14510
  Gene Symbol: ARHGAP22
  Gene Name: Rho GTPase activating protein 22
  ENSP ID: ENSP00000363285
MGLCCCKDWRGHLRAPKGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDRFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 73248 - protein, 589 aa, Homo sapiens
  Payload ID: 14510
  Gene Symbol: ARHGAP22
  Gene Name: Rho GTPase activating protein 22
  ENSP ID: ENSP00000363287
MASSQRDMEDWVQAIRRVIWAPLGGGTARRSHAHPLEPLPPGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 73249 - protein, 608 aa, Homo sapiens
  Payload ID: 14510
  Gene Symbol: ARHGAP22
  Gene Name: Rho GTPase activating protein 22
  Uniprot ID: Q7Z5H3
  ENSP ID: ENSP00000410054
MPFWPIRCLKRSRRMPRGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 73250 - protein, 714 aa, Homo sapiens
  Payload ID: 14510
  Gene Symbol: ARHGAP22
  Gene Name: Rho GTPase activating protein 22
  Uniprot ID: Q7Z5H3
  ENSP ID: ENSP00000412461
MLSPKIRQARRARSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGTARRSHAHPLEPLPPGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 73251 - protein, 704 aa, Homo sapiens
  Payload ID: 14510
  Gene Symbol: ARHGAP22
  Gene Name: Rho GTPase activating protein 22
  Uniprot ID: Q7Z5H3
  ENSP ID: ENSP00000416701
MLPTASSKRRTFAARYFTRSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 73252 - protein, 261 aa, Homo sapiens
  Payload ID: 14510
  Gene Symbol: ARHGAP22
  Gene Name: Rho GTPase activating protein 22
  ENSP ID: ENSP00000422663
MLPTASSKRRTFAARYFTRSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARALWSWLNK

SEQ ID NO: 73253 - protein, 531 aa, Homo sapiens
  Payload ID: 14510
  Gene Symbol: ARHGAP22
  Gene Name: Rho GTPase activating protein 22
  ENSP ID: ENSP00000422868
MCVPPHRKDGSIPCPRALCSQSVDIQAWQLSAAQRGDVGQPREFWHLRSQVPVPTCHLLTVQPWCLLPHPTPAGGRERRHSASSLLAALCLRKAVLRPHPAVLPGVGGCVVLSSGRMKAPLRGGLALGTGPAPTKLQLLHDWQSEPGPSGWQQGPSPPLFPAGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 73254 - protein, 135 aa, Homo sapiens
  Payload ID: 14511
  Gene Symbol: ARHGAP23
  Gene Name: Rho GTPase activating protein 23
  ENSP ID: ENSP00000478142
IRDLPGHYYETLKFLVGHLKTIADHSEKNKMEPRNLALVFGPTLVRTSEDNMTDMVTHMPDRYKIVETLIQHSDWFFSDEEDKGERILPPVVQPSPRVRGPPRRSRTPGRCWRSPSSRPSTASARSGGRRGGWAA

SEQ ID NO: 73255 - protein, 1491 aa, Homo sapiens
  Payload ID: 14511
  Gene Symbol: ARHGAP23
  Gene Name: Rho GTPase activating protein 23
  Uniprot ID: Q9P227
  ENSP ID: ENSP00000479208
MNGVAFCLVGIPPRPEPRPPQLPLGPRDGCSPRRPFPWQGPRTLLLYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSGYSTLSTMDRSVCSGASGRRAGAGDEADDERSELSHVETDTEGAAGAGPGGRLTRRPSFSSHHLMPCDTLARRRLARGRPDGEGAGRGGPRAPEPPGSASSSSQESLRPPAAALASRPSRMEALRLRLRGTADDMLAVRLRRPLSPETRRRRSSWRRHTVVVQSPLTDLNFNEWKELGGGGPPEPAGARAHSDNKDSGLSSLESTKARAPSSAASQPPAPGDTGSLQSQPPRRSAASRLHQCL

SEQ ID NO: 73256 - protein, 163 aa, Homo sapiens
  Payload ID: 14511
  Gene Symbol: ARHGAP23
  Gene Name: Rho GTPase activating protein 23
  ENSP ID: ENSP00000481292
  MOD_RES (1)..(1): Any amino acid
XTFSDIRREGWLYYKQILTKKGKAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRI

SEQ ID NO: 73257 - protein, 1491 aa, Homo sapiens; identical to SEQ ID NO: 73255
  Payload ID: 14511
  Gene Symbol: ARHGAP23
  Gene Name: Rho GTPase activating protein 23
  Uniprot ID: Q9P227
  ENSP ID: ENSP00000481862

SEQ ID NO: 73258 - protein, 83 aa, Homo sapiens
  Payload ID: 14511
  Gene Symbol: ARHGAP23
  Gene Name: Rho GTPase activating protein 23
  ENSP ID: ENSP00000482425
RVPLIVAACCRIVEARGLESTGIYRVPGNNAVVSSLQEQLNRGPGDINLQDERWQDLNVISSLLKSFFRKLPEPLFTDGALLF

SEQ ID NO: 73259 - protein, 102 aa, Homo sapiens
  Payload ID: 14511
  Gene Symbol: ARHGAP23
  Gene Name: Rho GTPase activating protein 23
  ENSP ID: ENSP00000482982
MDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYA

SEQ ID NO: 73260 - protein, 1144 aa, Homo sapiens
  Payload ID: 14511
  Gene Symbol: ARHGAP23
  Gene Name: Rho GTPase activating protein 23
  Uniprot ID: Q9P227
  ENSP ID: ENSP00000482992
MNGVAFCLVGIPPRPEPRPPQLPLGPRDGCSPRRPFPWQGPRTLLLYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSADLLEI

SEQ ID NO: 73261 - protein, 129 aa, Homo sapiens
  Payload ID: 14511
  Gene Symbol: ARHGAP23
  Gene Name: Rho GTPase activating protein 23
  ENSP ID: ENSP00000483748
SKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAG

SEQ ID NO: 73262 - protein, 64 aa, Homo sapiens
  Payload ID: 14511
  Gene Symbol: ARHGAP23
  Gene Name: Rho GTPase activating protein 23
  ENSP ID: ENSP00000484509
  MOD_RES (1)..(1): Any amino acid
XFFSDEEDKGERTPVGDKEPQAVPNIEYLLPNIGRTVPPGDPGSDSTTCSSAKSKVRMKAILKA

SEQ ID NO: 73263 - protein, 129 aa, Homo sapiens; identical to SEQ ID NO: 73261
  Payload ID: 14511
  Gene Symbol: ARHGAP23
  Gene Name: Rho GTPase activating protein 23
  ENSP ID: ENSP00000487883

SEQ ID NO: 73264 - protein, 64 aa, Homo sapiens; identical to SEQ ID NO: 73262
  Payload ID: 14511
  Gene Symbol: ARHGAP23
  Gene Name: Rho GTPase activating protein 23
  ENSP ID: ENSP00000487994
  MOD_RES (1)..(1): Any amino acid

SEQ ID NO: 73265 - protein, 135 aa, Homo sapiens; identical to SEQ ID NO: 73254
  Payload ID: 14511
  Gene Symbol: ARHGAP23
  Gene Name: Rho GTPase activating protein 23
  ENSP ID: ENSP00000488310

SEQ ID NO: 73266 - protein, 1144 aa, Homo sapiens; identical to SEQ ID NO: 73260
  Payload ID: 14511
  Gene Symbol: ARHGAP23
  Gene Name: Rho GTPase activating protein 23
  Uniprot ID: Q9P227
  ENSP ID: ENSP00000488428

SEQ ID NO: 73267 - protein, 83 aa, Homo sapiens; identical to SEQ ID NO: 73258
  Payload ID: 14511
  Gene Symbol: ARHGAP23
  Gene Name: Rho GTPase activating protein 23
  ENSP ID: ENSP00000488699

SEQ ID NO: 73268 - protein, 163 aa, Homo sapiens; identical to SEQ ID NO: 73256
  Payload ID: 14511
  Gene Symbol: ARHGAP23
  Gene Name: Rho GTPase activating protein 23
  ENSP ID: ENSP00000488827
  MOD_RES (1)..(1): Any amino acid

SEQ ID NO: 73269 - protein, 102 aa, Homo sapiens; identical to SEQ ID NO: 73259
  Payload ID: 14511
  Gene Symbol: ARHGAP23
  Gene Name: Rho GTPase activating protein 23
  ENSP ID: ENSP00000488885

SEQ ID NO: 73270 - protein, 655 aa, Homo sapiens
  Payload ID: 14512
  Gene Symbol: ARHGAP24
  Gene Name: Rho GTPase activating protein 24
  Uniprot ID: Q8N264
  ENSP ID: ENSP00000264343
MPEDRNSGGCPAGALASTPFIPKTTYRRIKRCFSFRKGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 73271 - protein, 653 aa, Homo sapiens
  Payload ID: 14512
  Gene Symbol: ARHGAP24
  Gene Name: Rho GTPase activating protein 24
  Uniprot ID: Q8N264
  ENSP ID: ENSP00000378610
MTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 73272 - protein, 748 aa, Homo sapiens
  Payload ID: 14512
  Gene Symbol: ARHGAP24
  Gene Name: Rho GTPase activating protein 24
  Uniprot ID: Q8N264
  ENSP ID: ENSP00000378611
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 73273 - protein, 246 aa, Homo sapiens
  Payload ID: 14512
  Gene Symbol: ARHGAP24
  Gene Name: Rho GTPase activating protein 24
  Uniprot ID: Q8N264
  ENSP ID: ENSP00000423206
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAVS

SEQ ID NO: 73274 - protein, 118 aa, Homo sapiens
  Payload ID: 14512
  Gene Symbol: ARHGAP24
  Gene Name: Rho GTPase activating protein 24
  ENSP ID: ENSP00000424256
MFVQGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEA

SEQ ID NO: 73275 - protein, 622 aa, Homo sapiens
  Payload ID: 14512
  Gene Symbol: ARHGAP24
  Gene Name: Rho GTPase activating protein 24
  ENSP ID: ENSP00000425589
MFVQGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERA

SEQ ID NO: 73276 - protein, 82 aa, Homo sapiens
  Payload ID: 14512
  Gene Symbol: ARHGAP24
  Gene Name: Rho GTPase activating protein 24
  ENSP ID: ENSP00000426105
MTANHESYLLMASTQNDMEDWVKSIRRVIWGPFGGGIFGQKLEDTVRYEKRYGNRLAPMLVEQCVDFIRQRGLKEEGLFRLP

SEQ ID NO: 73277 - protein, 639 aa, Homo sapiens
  Payload ID: 14513
  Gene Symbol: ARHGAP25
  Gene Name: Rho GTPase activating protein 25
  Uniprot ID: P42331
  ENSP ID: ENSP00000386241
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 73278 - protein, 638 aa, Homo sapiens
  Payload ID: 14513
  Gene Symbol: ARHGAP25
  Gene Name: Rho GTPase activating protein 25
  Uniprot ID: P42331
  ENSP ID: ENSP00000386863
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 73279 - protein, 646 aa, Homo sapiens
  Payload ID: 14513
  Gene Symbol: ARHGAP25
  Gene Name: Rho GTPase activating protein 25
  Uniprot ID: P42331
  ENSP ID: ENSP00000386911
MSLKLPRNWDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 73280 - protein, 458 aa, Homo sapiens
  Payload ID: 14513
  Gene Symbol: ARHGAP25
  Gene Name: Rho GTPase activating protein 25
  Uniprot ID: P42331
  ENSP ID: ENSP00000417139
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMVRCREPSCFHWVLPLVQAIPCKACSRVAIWGVLGDAVAVGAAATDSSEHTLKAWPLSKSSFYWHL

SEQ ID NO: 73281 - protein, 283 aa, Homo sapiens
  Payload ID: 14513
  Gene Symbol: ARHGAP25
  Gene Name: Rho GTPase activating protein 25
  ENSP ID: ENSP00000417283
MTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKNYRNRNDCQSVVSAQIHQFCPRVSLLAHGQAHLLVNDLLV

SEQ ID NO: 73282 - protein, 85 aa, Homo sapiens
  Payload ID: 14513
  Gene Symbol: ARHGAP25
  Gene Name: Rho GTPase activating protein 25
  ENSP ID: ENSP00000417425
MSLGQSACLFLSIARSRSVMTGEQMAAFHPSSTPNPLERPIKMGWLKKQRSIVKNWQQSGPPGSTRTGTVEFPTHGSESRLATGR

SEQ ID NO: 73283 - protein, 339 aa, Homo sapiens
  Payload ID: 14513
  Gene Symbol: ARHGAP25
  Gene Name: Rho GTPase activating protein 25
  ENSP ID: ENSP00000417467
MSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 73284 - protein, 505 aa, Homo sapiens
  Payload ID: 14513
  Gene Symbol: ARHGAP25
  Gene Name: Rho GTPase activating protein 25
  ENSP ID: ENSP00000417818
  MOD_RES (1)..(1): Any amino acid
XAQNDGQVLFALSSAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 73285 - protein, 139 aa, Homo sapiens
  Payload ID: 14513
  Gene Symbol: ARHGAP25
  Gene Name: Rho GTPase activating protein 25
  ENSP ID: ENSP00000420427
MSLKLPRNWDFNLKVEAAKIARSRSVMTGEQMAAFHPSSTPNPLERPIKMGWLKKQRSIVKNWQQRYFVLRAQQLYYYKDEEDTKPQQCLASAWMRLWPMNRNSAPIWCPSWWRNVQSSSWSTAGMKRASSVCLGRTTW

SEQ ID NO: 73286 - protein, 606 aa, Homo sapiens
  Payload ID: 14513
  Gene Symbol: ARHGAP25
  Gene Name: Rho GTPase activating protein 25
  Uniprot ID: P42331
  ENSP ID: ENSP00000420583
MSLKLPRNWDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 73287 - protein, 814 aa, Homo sapiens
  Payload ID: 14514
  Gene Symbol: ARHGAP26
  Gene Name: Rho GTPase activating protein 26
  Uniprot ID: Q9UNA1
  ENSP ID: ENSP00000274498
MGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNVHPSQEPGWLEGTLNGKTGLIPENYVEFL

SEQ ID NO: 73288 - protein, 759 aa, Homo sapiens
  Payload ID: 14514
  Gene Symbol: ARHGAP26
  Gene Name: Rho GTPase activating protein 26
  Uniprot ID: Q9UNA1
  ENSP ID: ENSP00000367243
MGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVSTPFRKAKALYACKAEHDSELSFTAGTVFDNVHPSQEPGWLEGTLNGKTGLIPENYVEFL

SEQ ID NO: 73289 - protein, 166 aa, Homo sapiens
  Payload ID: 14514
  Gene Symbol: ARHGAP26
  Gene Name: Rho GTPase activating protein 26
  ENSP ID: ENSP00000367252
MEPLAPSPRIWTCVFYFGIESEEDLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMF

SEQ ID NO: 73290 - protein, 154 aa, Homo sapiens
  Payload ID: 14514
  Gene Symbol: ARHGAP26
  Gene Name: Rho GTPase activating protein 26
  ENSP ID: ENSP00000389137
  MOD_RES (1)..(1): Any amino acid
XPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNAECPSASTAIFTATPKLRAPPPLTWALPLAA

SEQ ID NO: 73291 - protein, 97 aa, Homo sapiens
  Payload ID: 14514
  Gene Symbol: ARHGAP26
  Gene Name: Rho GTPase activating protein 26
  ENSP ID: ENSP00000392186
AKLENQESRVSEIHSLVHRLPEKNRQMLQLLMNHLAKYAGGLGKKCVKCSLQWRTAANARWPSQRMLGKCSCNQATKQSFQGDFTYGDQGQIGVCCP

SEQ ID NO: 73292 - protein, 388 aa, Homo sapiens
  Payload ID: 14514
  Gene Symbol: ARHGAP26
  Gene Name: Rho GTPase activating protein 26
  ENSP ID: ENSP00000393276
  MOD_RES (1)..(1): Any amino acid
XAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRPEEAVHEDSSTPFRKAKALYACKAEHDSELSFTAGTVFDNVHPSQEPGWLEGTLNGKTGLIPENYVEFL

SEQ ID NO: 73293 - protein, 127 aa, Homo sapiens
  Payload ID: 14514
  Gene Symbol: ARHGAP26
  Gene Name: Rho GTPase activating protein 26
  ENSP ID: ENSP00000400565
VIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLHWGFGMCLEGCTEVQSPAS

SEQ ID NO: 73294 - protein, 98 aa, Homo sapiens
  Payload ID: 14514
  Gene Symbol: ARHGAP26
  Gene Name: Rho GTPase activating protein 26
  ENSP ID: ENSP00000403388
  MOD_RES (1)..(1): Any amino acid
XPNPSPTSPLSPSWPMFSAPSSPMPTSSTSSDSSPVSTPFRKAKALYACKAEHDSELSFTAGTVFDNAECPSASTAIFTATPKLRAPPPLTWALPLAA

SEQ ID NO: 73295 - protein, 91 aa, Homo sapiens
  Payload ID: 14514
  Gene Symbol: ARHGAP26
  Gene Name: Rho GTPase activating protein 26
  ENSP ID: ENSP00000411571
MVPFDQKSGGKGGEDESVILKSCTRRKTDSIEKRFCFDVEAVDRPGVITMQALSEEDRRLWMEAMDGREPVYNSNKDSQSEGTAQLDSIGF

SEQ ID NO: 73296 - protein, 127 aa, Homo sapiens
  Payload ID: 14514
  Gene Symbol: ARHGAP26
  Gene Name: Rho GTPase activating protein 26
  ENSP ID: ENSP00000413283
IVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLVQPPRQLCSLPSKPALAF

SEQ ID NO: 73297 - protein, 294 aa, Homo sapiens
  Payload ID: 14514
  Gene Symbol: ARHGAP26
  Gene Name: Rho GTPase activating protein 26
  ENSP ID: ENSP00000416889
  MOD_RES (1)..(1): Any amino acid
XPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLTPFRKAKALYACKAEHDSELSFTAGTVFDNVHPSQEPGWLEGTLNGKTGLIPENYVEFL

SEQ ID NO: 73298 - protein, 263 aa, Homo sapiens
  Payload ID: 14515
  Gene Symbol: ARHGAP27
  Gene Name: Rho GTPase activating protein 27
  Uniprot ID: Q6ZUM4
  ENSP ID: ENSP00000290470
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPPEESAEQVPPRALGRGGGWRARDRARTEPGRKETRSAQRRARRPPLSEDFG

SEQ ID NO: 73299 - protein, 548 aa, Homo sapiens
  Payload ID: 14515
  Gene Symbol: ARHGAP27
  Gene Name: Rho GTPase activating protein 27
  Uniprot ID: Q6ZUM4
  ENSP ID: ENSP00000366121
MQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 73300 - protein, 889 aa, Homo sapiens
  Payload ID: 14515
  Gene Symbol: ARHGAP27
  Gene Name: Rho GTPase activating protein 27
  Uniprot ID: Q6ZUM4
  ENSP ID: ENSP00000403323
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPPEESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 73301 - protein, 521 aa, Homo sapiens
  Payload ID: 14515
  Gene Symbol: ARHGAP27
  Gene Name: Rho GTPase activating protein 27
  ENSP ID: ENSP00000431591
MQPGLSPGSPGDPRPPTPETDYPESLTSYPEEDYSPVGSFGEPGPTSPLTTPPGWSCHVSQDKQMLYTNHFTQEQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 73302 - protein, 77 aa, Homo sapiens
  Payload ID: 14515
  Gene Symbol: ARHGAP27
  Gene Name: Rho GTPase activating protein 27
  ENSP ID: ENSP00000431722
MQPGLSPGSPGDPRPPTPETDYPESLTSYPEEDYSPVGSFVGEAGGPPREAILLQSRGLLCSMGAAPGPCPCPSKHP

SEQ ID NO: 73303 - protein, 667 aa, Homo sapiens
  Payload ID: 14515
  Gene Symbol: ARHGAP27
  Gene Name: Rho GTPase activating protein 27
  ENSP ID: ENSP00000432762
MVDIIAKVTRRQSRALPAQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 73304 - protein, 867 aa, Homo sapiens
  Payload ID: 14515
  Gene Symbol: ARHGAP27
  Gene Name: Rho GTPase activating protein 27
  ENSP ID: ENSP00000433942
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRASSLCGPAQRGAATQRSSLAPGLPACLYLRPAAPVRPAQSLNDLACAAVSPPAGLLGSSGSFKACSVAGSWVCPRPLARSDSENVYEVIQDLHVPPPEESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 73305 - protein, 263 aa, Homo sapiens; identical to SEQ ID NO: 73298
  Payload ID: 14515
  Gene Symbol: ARHGAP27
  Gene Name: Rho GTPase activating protein 27
  Uniprot ID: Q6ZUM4
  ENSP ID: ENSP00000436137

SEQ ID NO: 73306 - protein, 214 aa, Homo sapiens
  Payload ID: 14515
  Gene Symbol: ARHGAP27
  Gene Name: Rho GTPase activating protein 27
  ENSP ID: ENSP00000437100
MVDIIAKVTRRQSRALPAQVDDPPEPVYANIERQPRATSPGAAAAPLPSPVWETHTDAGTGRPYYYNPDTGVTTWESPFEAAEGAASPATSPASVDSHPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEK

SEQ ID NO: 73307 - protein, 889 aa, Homo sapiens; identical to SEQ ID NO: 73300
  Payload ID: 14515
  Gene Symbol: ARHGAP27
  Gene Name: Rho GTPase activating protein 27
  Uniprot ID: Q6ZUM4
  ENSP ID: ENSP00000477741

SEQ ID NO: 73308 - protein, 548 aa, Homo sapiens; identical to SEQ ID NO: 73299
  Payload ID: 14515
  Gene Symbol: ARHGAP27
  Gene Name: Rho GTPase activating protein 27
  Uniprot ID: Q6ZUM4
  ENSP ID: ENSP00000478738

SEQ ID NO: 73309 - protein, 548 aa, Homo sapiens; identical to SEQ ID NO: 73299
  Payload ID: 14515
  Gene Symbol: ARHGAP27
  Gene Name: Rho GTPase activating protein 27
  Uniprot ID: Q6ZUM4
  ENSP ID: ENSP00000480582

SEQ ID NO: 73310 - protein, 263 aa, Homo sapiens; identical to SEQ ID NO: 73298
  Payload ID: 14515
  Gene Symbol: ARHGAP27
  Gene Name: Rho GTPase activating protein 27
  Uniprot ID: Q6ZUM4
  ENSP ID: ENSP00000481302

SEQ ID NO: 73311 - protein, 889 aa, Homo sapiens
  Payload ID: 14515
  Gene Symbol: ARHGAP27
  Gene Name: Rho GTPase activating protein 27
  ENSP ID: ENSP00000482352
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRTSSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKVPAELDEVGSWEEVSPATAAVRTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 73312 - protein, 263 aa, Homo sapiens
  Payload ID: 14515
  Gene Symbol: ARHGAP27
  Gene Name: Rho GTPase activating protein 27
  ENSP ID: ENSP00000482605
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRTSSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVPPRALGRGGGWRARDRARTEPGRKETRSAQRRARRPPLSEDFG

SEQ ID NO: 73313 - protein, 667 aa, Homo sapiens; identical to SEQ ID NO: 73303
  Payload ID: 14515
  Gene Symbol: ARHGAP27
  Gene Name: Rho GTPase activating protein 27
  ENSP ID: ENSP00000485742

SEQ ID NO: 73314 - protein, 77 aa, Homo sapiens; identical to SEQ ID NO: 73302
  Payload ID: 14515
  Gene Symbol: ARHGAP27
  Gene Name: Rho GTPase activating protein 27
  ENSP ID: ENSP00000485800

SEQ ID NO: 73315 - protein, 214 aa, Homo sapiens; identical to SEQ ID NO: 73306
  Payload ID: 14515
  Gene Symbol: ARHGAP27
  Gene Name: Rho GTPase activating protein 27
  ENSP ID: ENSP00000486620

SEQ ID NO: 73316 - protein, 867 aa, Homo sapiens
  Payload ID: 14515
  Gene Symbol: ARHGAP27
  Gene Name: Rho GTPase activating protein 27
  ENSP ID: ENSP00000486749
MAADVVGDVYVLVEHPFEYTGKDGRRVAIRPNERYRLLRRSTEHWWHVRREPGGRPFYLPAQYVRELPALGNPAAAAPPGPHPSPAAPEPLAYDYRFVSAAATAGPDGAPEESGGRTSSLCGPAQRGAATQRSSLAPGLPACLYLRPAAPVRPAQSLNDLACAAVSPPAGLLGSSGSFKACSVAGSWVCPRPLARSDSENVYEVIQDLHVPPREESAEQVDDPPEPVYANIERQPRATSPGAAAAPLPSPVWETHTDAGTGRPYYYNPDTGVTTWESPFEAAEGAASPATSPASVDSHVSLETEWGQYWDEESRRVFFYNPLTGETAWEDEAENEPEEELEMQPGLSPGSPGDPRPPTPETDYPESLTSYPEEDYSPVGSFGEPGPTSPLTTPPGWSCHVSQDKQMLYTNHFTQEQWVRLEDPHGKPYFYNPEDSSVRWELPQVPVPAPRSIHKSSQDGDTPAQASPPEEKTKTLDKAGVLHRTKTADKGKRLRKKHWSASWTVLEGGVLTFFKDSKTSAAGGLRQPSKFSTPEYTVELRGATLSWAPKDKSSRKNVLELRSRDGSEYLIQHDSEAIISTWHKAIAQGIQELSAELPPEESESSRVDFGSSERLGSWQEKEEDARPNAAAPALGPVGLESDLSKVRHKLRKFLQRRPTLQSLREKGYIKDQVFGCALAALCERERSRVPRFVQQCIRAVEARGLDIDGLYRISGNLATIQKLRYKVDHDERLDLDDGRWEDVHVITGALKLFFRELPEPLFPFSHFRQFIAAIKLQDQARRSRCVRDLVRSLPAPNHDTLRMLFQHLCRVIEHGEQNRMSVQSVAIVFGPTLLRPEVEETSMPMTMVFQNQVVELILQQCADIFPPH

SEQ ID NO: 73317 - protein, 521 aa, Homo sapiens; identical to SEQ ID NO: 73301
  Payload ID: 14515
  Gene Symbol: ARHGAP27
  Gene Name: Rho GTPase activating protein 27
  ENSP ID: ENSP00000487100

SEQ ID NO: 73318 - protein, 263 aa, Homo sapiens; identical to SEQ ID NO: 73312
  Payload ID: 14515
  Gene Symbol: ARHGAP27
  Gene Name: Rho GTPase activating protein 27
  ENSP ID: ENSP00000487172

SEQ ID NO: 73319 - protein, 77 aa, Homo sapiens; identical to SEQ ID NO: 73302
  Payload ID: 14515
  Gene Symbol: ARHGAP27
  Gene Name: Rho GTPase activating protein 27
  ENSP ID: ENSP00000487852

SEQ ID NO: 73320 - protein, 263 aa, Homo sapiens; identical to SEQ ID NO: 73298
  Payload ID: 14515
  Gene Symbol: ARHGAP27
  Gene Name: Rho GTPase activating protein 27
  Uniprot ID: Q6ZUM4
  ENSP ID: ENSP00000487991

SEQ ID NO: 73321 - protein, 667 aa, Homo sapiens; identical to SEQ ID NO: 73303
  Payload ID: 14515
  Gene Symbol: ARHGAP27
  Gene Name: Rho GTPase activating protein 27
  ENSP ID: ENSP00000488279

SEQ ID NO: 73322 - protein, 867 aa, Homo sapiens; identical to SEQ ID NO: 73304
  Payload ID: 14515
  Gene Symbol: ARHGAP27
  Gene Name: Rho GTPase activating protein 27
  ENSP ID: ENSP00000488330

SEQ ID NO: 73323 - protein, 214 aa, Homo sapiens; identical to SEQ ID NO: 73306
  Payload ID: 14515
  Gene Symbol: ARHGAP27
  Gene Name: Rho GTPase activating protein 27
  ENSP ID: ENSP00000488351

SEQ ID NO: 73324 - protein, 521 aa, Homo sapiens; identical to SEQ ID NO: 73301
  Payload ID: 14515
  Gene Symbol: ARHGAP27
  Gene Name: Rho GTPase activating protein 27
  ENSP ID: ENSP00000488767

SEQ ID NO: 73325 - protein, 670 aa, Homo sapiens
  Payload ID: 14516
  Gene Symbol: ARHGAP28
  Gene Name: Rho GTPase activating protein 28
  Uniprot ID: Q9P2N2
  ENSP ID: ENSP00000262227
MLSNESLHPPAFSRSNSEASVDSASMEDFWREIESIKDSSMGGQEEPPPAEVTPVDEGELEAEWLQDVGLSTLISGDEEEDGKALLSTLTRTQAAAVQKRYHTYTQTMRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 73326 - protein, 570 aa, Homo sapiens
  Payload ID: 14516
  Gene Symbol: ARHGAP28
  Gene Name: Rho GTPase activating protein 28
  Uniprot ID: Q9P2N2
  ENSP ID: ENSP00000313506
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENSHGSSECIKIQNQRLYEIGGNIGEHCLDPDAYILDVYRINPQAEWVIKPQQSS

SEQ ID NO: 73327 - protein, 729 aa, Homo sapiens
  Payload ID: 14516
  Gene Symbol: ARHGAP28
  Gene Name: Rho GTPase activating protein 28
  Uniprot ID: Q9P2N2
  ENSP ID: ENSP00000372964
MEVEDSGGVVLTAYHSYARAQPPNAESRCAPRAAASHPLSRKSIPRCRRINRMLSNESLHPPAFSRSNSEASVDSASMEDFWREIESIKDSSMGGQEEPPPAEVTPVDEGELEAEWLQDVGLSTLISGDEEEDGKALLSTLTRTQAAAVQKRYHTYTQTMRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENSHGSSECIKIQNQRLYEIGGNIGEHCLDPDAYILDVYRINPQAEWVIKPQQSS

SEQ ID NO: 73328 - protein, 570 aa, Homo sapiens; identical to SEQ ID NO: 73326
  Payload ID: 14516
  Gene Symbol: ARHGAP28
  Gene Name: Rho GTPase activating protein 28
  Uniprot ID: Q9P2N2
  ENSP ID: ENSP00000392660

SEQ ID NO: 73329 - protein, 117 aa, Homo sapiens
  Payload ID: 14516
  Gene Symbol: ARHGAP28
  Gene Name: Rho GTPase activating protein 28
  ENSP ID: ENSP00000433390
MLSNESLHPPAFSRSNSEASVDSASMEDFWREIESIKDSSMGGQEEPPPAEVTPVDEGELEAEWLQDVGLSTLISGDEEEDGKALLSTLTRTQAAAVQKRYHTYTQTMRKKDKQSIR

SEQ ID NO: 73330 - protein, 545 aa, Homo sapiens
  Payload ID: 14516
  Gene Symbol: ARHGAP28
  Gene Name: Rho GTPase activating protein 28
  Uniprot ID: Q9P2N2
  ENSP ID: ENSP00000435990
MNELPRDTCGNHTNQLDGTKEERELPRVIKTSGSMPDDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENRILHWQRAALSFLNGKWVKKEREESTETNRSPKHVFLFTIGLDIST

SEQ ID NO: 73331 - protein, 565 aa, Homo sapiens
  Payload ID: 14516
  Gene Symbol: ARHGAP28
  Gene Name: Rho GTPase activating protein 28
  ENSP ID: ENSP00000437262
MRKKDKQSIRDVRDIFGVSESPPRDTCGNHTNQLDGTKEERELPRVIKTNDASLNSTTLSDASQDKEGSFAVPRSDSVAILETIPVLPVHSNGSPEPGQPVQNAISDDDFLEKNIPPEAEELSFEVSYSEMVTEALKRNKLKKSEIKKEDYVLTKFNVQKTRFGLTEAGDLSAEDMKKIRHLSLIELTAFFDAFGIQLKRNKTEKVKGRDNGIFGVPLTVLLDGDRKKDPGVKVPLVLQKFFEKVEESGLESEGIFRLSGCTAKVKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHIIRLMLKYQKILWKVPSFLITQVRRMNEATMLLKKQLPSVRKLLRRKTLERETASPKTSKVLQKSPSARRMSDVPEGVIRVHAPLLSKVSMAIQLNNQTKAKDILAKFQYENSHGSSECIKIQNQRLYEIGGNIGEHCLDPDAYILDVYRINPQAEWVIKPQQSS

SEQ ID NO: 73332 - protein, 137 aa, Homo sapiens
  Payload ID: 14516
  Gene Symbol: ARHGAP28
  Gene Name: Rho GTPase activating protein 28
  ENSP ID: ENSP00000462831
MSEPGVLCIVFDWRKSIPRCRRINRMLSNESLHPPAFSRSNSEASVDSASMEDFWREIESDEEEDGKALLSTLTRTQAAAVQKRYHTYTQTMRKKDKQSIRDVRDIFGVSESPPRDTCGNHTNQLDGTKEERELPRV

SEQ ID NO: 73333 - protein, 111 aa, Homo sapiens
  Payload ID: 14516
  Gene Symbol: ARHGAP28
  Gene Name: Rho GTPase activating protein 28
  ENSP ID: ENSP00000462912
MRKKDKQSIRDVRDIFGVSESPPRDTCGNHTNQLDGTKEERELPRVIKTSGSMPDDASLNSTTLSDASQDKEGSFAVPRSDSVAILETIPVLPVHSNGSPEPGQPVQNAIS

SEQ ID NO: 73334 - protein, 202 aa, Homo sapiens
  Payload ID: 14516
  Gene Symbol: ARHGAP28
  Gene Name: Rho GTPase activating protein 28
  ENSP ID: ENSP00000463143
EDMKKIRHLSLIELTAFFDAFGIQLKRNKTEKVKGRDNGIFGVPLTVLLDGDRKKDPGVKVPLVLQKQYREELDAKFNADKFKWDKMCHREAAVMLKAFFRELPTSLFPVEYIPAFISLMERGPHVKVQFQALHLMVMALPDANRDAAQALMTFFNKVIANESKNRMSLWNISTVMAPNLFFSRSKHSDYEELLLANTAAHI

SEQ ID NO: 73335 - protein, 57 aa, Homo sapiens
  Payload ID: 14516
  Gene Symbol: ARHGAP28
  Gene Name: Rho GTPase activating protein 28
  ENSP ID: ENSP00000463672
MRKKDKQSIRDVRDIFGVSESPPRDTCGNHTNQLDGTKEERELPRVIKTSGSMYYPV

SEQ ID NO: 73336 - protein, 73 aa, Homo sapiens
  Payload ID: 14516
  Gene Symbol: ARHGAP28
  Gene Name: Rho GTPase activating protein 28
  ENSP ID: ENSP00000464141
MNLIQGKSIPRCRRINRMLSNESLHPPAFSRSNSEASVDSASMEDFWREIESIKDSSMGGQEEPPPAEVTPVD

SEQ ID NO: 73337 - protein, 57 aa, Homo sapiens; identical to SEQ ID NO: 73335
  Payload ID: 14516
  Gene Symbol: ARHGAP28
  Gene Name: Rho GTPase activating protein 28
  ENSP ID: ENSP00000464310

SEQ ID NO: 73338 - protein, 1261 aa, Homo sapiens
  Payload ID: 14517
  Gene Symbol: ARHGAP29
  Gene Name: Rho GTPase activating protein 29
  Uniprot ID: Q52LW3
  ENSP ID: ENSP00000260526
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEGEIPQFV

SEQ ID NO: 73339 - protein, 393 aa, Homo sapiens
  Payload ID: 14517
  Gene Symbol: ARHGAP29
  Gene Name: Rho GTPase activating protein 29
  Uniprot ID: Q52LW3
  ENSP ID: ENSP00000359237
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVTIFFFFICKLN

SEQ ID NO: 73340 - protein, 1035 aa, Homo sapiens
  Payload ID: 14517
  Gene Symbol: ARHGAP29
  Gene Name: Rho GTPase activating protein 29
  ENSP ID: ENSP00000449764
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPETLIQNYRVLHLQYVFCC

SEQ ID NO: 73341 - protein, 1101 aa, Homo sapiens
  Payload ID: 14518
  Gene Symbol: ARHGAP30
  Gene Name: Rho GTPase activating protein 30
  Uniprot ID: Q7Z6I6
  ENSP ID: ENSP00000356992
MKSRQKGKKKGSAKERVFGCDLQEHLQHSGQEVPQVLKSCAEFVEEYGVVDGIYRLSGVSSNIQKLRQEFESERKPDLRRDVYLQDIHCVSSLCKAYFRELPDPLLTYRLYDKFAEAVGVQLEPERLVKILEVLRELPVPNYRTLEFLMRHLVHMASFSAQTNMHARNLAIVWAPNLLRSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPYNVNLPLHITSILSVPPNIISNVSLARLTRGLECPALQHRPSPASGPGPGPGLGPGPPDEKLEASPASSPLADSGPDDLAPALEDSLSQEVQDSFSFLEDSSSSEPEWVGAEDGEVAQAEAAGAAFSPGEDDPGMGYLEELLGVGPQVEEFSVEPPLDDLSLDEAQFVLAPSCCSLDSAGPRPEVEEENGEEVFLSAYDDLSPLLGPKPPIWKGSGSLEGEAAGCGRQALGQGGEEQACWEVGEDKQAEPGGRLDIREEAEGSPETKVEAGKASEDRGEAGGSQETKVRLREGSREETEAKEEKSKGQKKADSMEAKGVEEPGGDEYTDEKEKEIEREEDEQREEAQVEAGRDLEQGAQEDQVAEEKWEVVQKQEAEGVREDEDKGQREKGYHEARKDQGDGEDSRSPEAATEGGAGEVSKERESGDGEAEGDQRAGGYYLEEDTLSEGSGVASLEVDCAKEGNPHSSEMEEVAPQPPQPEEMEPEGQPSPDGCLCPCSLGLGGVGMRLASTLVQVQQVRSVPVVPPKPQFAKMPSAMCSKIHVAPANPCPRPGRLDGTPGERAWGSRASRSSWRNGGSLSFDAAVALARDRQRTEAQGVRRTQTCTEGGDYCLIPRTSPCSMISAHSPRPLSCLELPSEGAEGSGSRSRLSLPPREPQVPDPLLSSQRRSYAFETQANPGKGEGL

SEQ ID NO: 73342 - protein, 924 aa, Homo sapiens
  Payload ID: 14518
  Gene Symbol: ARHGAP30
  Gene Name: Rho GTPase activating protein 30
  ENSP ID: ENSP00000356994
MKSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPYNVNLPLHITSILSVPPNIISNVSLARLTRGLECPALQHRPSPASGPGPGPGLGPGPPDEKLEASPASSPLADSGPDDLAPALEDSLSQEVQDSFSFLEDSSSSEPEWVGAEDGEVAQAEAAGAAFSPGEDDPGMGYLEELLGVGPQVEEFSVEPPLDDLSLDEAQFVLAPSCCSLDSAGPRPEVEEENGEEVFLSAYDDLSPLLGPKPPIWKGSGSLEGEAAGCGRQALGQGGEEQACWEVGEDKQAEPGGRLDIREEAEGSPETKVEAGKASEDRGEAGGSQETKVRLREGSREETEAKEEKSKGQKKADSMEAKGVEEPGGDEYTDEKEKEIEREEDEQREEAQVEAGRDLEQGAQEDQVAEEKWEVVQKQEAEGVREDEDKGQREKGYHEARKDQGDGEDSRSPEAATEGGAGEVSKERESGDGEAEGDQRAGGYYLEEDTLSEGSGVASLEVDCAKEGNPHSSEMEEVAPQPPQPEEMEPEGQPSPDGCLCPCSLGLGGVGMRLASTLVQVQQVRSVPVVPPKPQFAKMPSAMCSKIHVAPANPCPRPGRLDGTPGERAWGSRASRSSWRNGGSLSFDAAVALARDRQRTEAQGVRRTQTCTEGGDYCLIPRTSPCSMISAHSPRPLSCLELPSEGAEGSGSRSRLSLPPREPQVPDPLLSSQRRSYAFETQANPGKGEGL

SEQ ID NO: 73343 - protein, 890 aa, Homo sapiens
  Payload ID: 14518
  Gene Symbol: ARHGAP30
  Gene Name: Rho GTPase activating protein 30
  ENSP ID: ENSP00000356995
MKSRQKGKKKGSAKERVFGCDLQEHLQHSGQEVPQVLKSCAEFVEEYGVVDGIYRLSGVSSNIQKLRQEFESERKPDLRRDVYLQDIHCVSSLCKAYFRELPDPLLTYRLYDKFAEAVGVQLEPERLVKILEVLRELPVPNYRTLEFLMRHLVHMASFSAQTNMHARNLAIVWAPNLLRSKDIEASGFNGTAAFMEVRVQSIVVEFILTHVDQLFGGAALSGGEVESGWRSLPGTRASGSPEDLMPRPLPYHLPSILQAGDGPPQMRPYHTIIEIAEHKRKGSLKVRKWRSIFNLGRSGHETKRKLPRGAEDREDKSNKGTLRPAKSMDSLSAAAGASDEPEGLVGPSSPRPSPLLPESLENDSIEAAEGEQEPEAEALGGTNSEPGTPRAGRSAIRAGGSSRAERCAGVHISDPYNVNLPLHITSILSVPPNIISNVSLARLTRGLECPALQHRPSPASGPGPGPGLGPGPPDEKLEASPASSPLADSGPDDLAPALEDSLSQEVQDSFSFLEDSSSSEPEWVGAEDGEVAQAEAAGAAFSPGEDDPGMGYLEELLGVGPQVEEFSVEPPLDDLSLDEAQFVLAPSCCSLDSAGPRPEVEEENGEEVFLSAYDDLSPLLGPKPPIWKGSGSLEGEAAGCGRQALGQGGEEQACWEVGEDKQAEPGGRLDIREEAEGTPQPPQPEEMEPEGQPSPDGCLCPCSLGLGGVGMRLASTLVQVQQVRSVPVVPPKPQFAKMPSAMCSKIHVAPANPCPRPGRLDGTPGERAWGSRASRSSWRNGGSLSFDAAVALARDRQRTEAQGVRRTQTCTEGGDYCLIPRTSPCSMISAHSPRPLSCLELPSEGAEGSGSRSRLSLPPREPQVPDPLLSSQRRSYAFETQANPGKGEGL

SEQ ID NO: 73344 - protein, 63 aa, Homo sapiens
  Payload ID: 14518
  Gene Symbol: ARHGAP30
  Gene Name: Rho GTPase activating protein 30
  ENSP ID: ENSP00000356997
MKSRQKGKKKGSAKERVFGCDLQEHLQHSGQEGSHSVTQQARVRLPAALASWAQVILPYQPPE

SEQ ID NO: 73345 - protein, 69 aa, Homo sapiens
  Payload ID: 14518
  Gene Symbol: ARHGAP30
  Gene Name: Rho GTPase activating protein 30
  ENSP ID: ENSP00000431291
MKSRQKGKKKGSAKERVFGCDLQEHLQHSGQEVPQVLKSCAEFVEEYGVVDGIYRLSGVSSNIQKLRRL

SEQ ID NO: 73346 - protein, 41 aa, Homo sapiens
  Payload ID: 14518
  Gene Symbol: ARHGAP30
  Gene Name: Rho GTPase activating protein 30
  ENSP ID: ENSP00000431387
MKSRQKGKKKGSAKERVFGCDLQEHLQHSGQEGGCRSAIGT

SEQ ID NO: 73347 - protein, 1444 aa, Homo sapiens
  Payload ID: 14519
  Gene Symbol: ARHGAP31
  Gene Name: Rho GTPase activating protein 31
  Uniprot ID: Q2M1Z3
  ENSP ID: ENSP00000264245
MKNKGAKQKLKRKGAASAFGCDLTEYLESSGQDVPYVLKSCAEFIETHGIVDGIYRLSGVTSNIQRLRQEFGSDQCPDLTREVYLQDIHCVGSLCKLYFRELPNPLLTYELYEKFTEAVSHCPEEGQLARIQNVIQELPPSHYRTLEYLIRHLAHIASFSSKTNMHARNLALVWAPNLLRSKEIEATGCNGDAAFLAVRVQQVVIEFILNHVDQIFNNGAPGSLENDENRPIMKSLTLPALSLPMKLVSLEEAQARSLATNHPARKERRENSLPEIVPPMGTLFHTVLELPDNKRKLSSKSKKWKSIFNLGRSGSDSKSKLSRNGSVFVRGQRLSVEKATIRPAKSMDSLCSVPVEGKETKGNFNRTVTTGGFFIPATKMHSTGTGSSCDLTKQEGEWGQEGMPPGAEGGFDVSSDRSHLQGAQARPPPEQLKVFRPVEDPESEQTAPKMLGMFYTSNDSPSKSVFTSSLFQMEPSPRNQRKALNISEPFAVSVPLRVSAVISTNSTPCRTPPKELQSLSSLEEFSFHGSESGGWPEEEKPLGAETSAASVPKKAGLEDAKAVPEAPGTVECSKGLSQEPGAHLEEKKTPESSLSSQHLNELEKRPNPEKVVEEGREAGEMESSTLQESPRARAEAVLLHEMDEDDLANALIWPEIQQELKIIESEEELSSLPPPALKTSPIQPILESSLGPFIPSEPPGSLPCGSFPAPVSTPLEVWTRDPANQSTQGASTAASREKPEPEQGLHPDLASLAPLEIVPFEKASPQATVEVGGPGNLSPPLPPAPPPPTPLEESTPVLLSKGGPEREDSSRKLRTDLYIDQLKSQDSPEISSLCQGEEATPRHSDKQNSKNAASEGKGCGFPSPTREVEIVSQEEEDVTHSVQEPSDCDEDDTVTDIAQHGLEMVEPWEEPQWVTSPLHSPTLKDAHKAQVQGLQGHQLEKRLSHRPSLRQSHSLDSKPTVKSQWTLEVPSSSSCANLETERNSDPLQPQAPRREITGWDEKALRSFREFSGLKGAEAPPNQKGPSGVQPNPAETSPISLAEGKELGTHLGHSSPQIRQGGVPGPESSKESSPSVQDSTSPGEHPAKLQLKSTECGPPKGKNRPSSLNLDPAIPIADLFWFENVASFSSPGMQVSEPGDPKVTWMTSSYCKADPWRVYSQDPQDLDIVAHALTGRRNSAPVSVSAVRTSFMVKMCQARAVPVIPPKIQYTQIPQPLPSQSSGENGVQPLERSQEGPSSTSGTTQKPAKDDSPSSLESSKEEKPKQDPGAIKSSPVDATAPCMCEGPTLSPEPGSSNLLSTQDAVVQCRKRMSETEPSGDNLLSSKLERPSGGSKPFHRSRPGRPQSLILFSPPFPIMDHLPPSSTVTDSKVLLSPIRSPTQTVSPGLLCGELAENTWVTPEGVTLRNKMTIPKNGQRLETSTSCFYQPQRRSVILDGRSGRQIE

SEQ ID NO: 73348 - protein, 165 aa, Homo sapiens
  Payload ID: 14519
  Gene Symbol: ARHGAP31
  Gene Name: Rho GTPase activating protein 31
  ENSP ID: ENSP00000418429
MCHLVPYVLKSCAEFIETHGIVDGIYRLSGVTSNIQRLRQEFGSDQCPDLTREVYLQDIHCVGSLCKLYFRELPNPLLTYELYEKFTEAVSHCPEEGQLARIQNVIQELPPSHYRTLEYLIRHLAHIASFSSKTNMHARNLALVWAPNLLRSKEIEATGCNGDAA

SEQ ID NO: 73349 - protein, 2087 aa, Homo sapiens
  Payload ID: 14520
  Gene Symbol: ARHGAP32
  Gene Name: Rho GTPase activating protein 32
  Uniprot ID: A7KAX9
  ENSP ID: ENSP00000310561
METESESSTLGDDSVFWLESEVIIQVTDCEEEEREEKFRKMKSSVHSEEDDFVPELHRNVHPRERPDWEETLSAMARGADVPEIPGDLTLKTCGSTASMKVKHVKKLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTLKDSPESVTQMLMAYLSRLSAIAGNKINCGPALTWMEIDNKGNHLLVHEESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 73350 - protein, 1738 aa, Homo sapiens
  Payload ID: 14520
  Gene Symbol: ARHGAP32
  Gene Name: Rho GTPase activating protein 32
  Uniprot ID: A7KAX9
  ENSP ID: ENSP00000376425
MKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 73351 - protein, 178 aa, Homo sapiens
  Payload ID: 14520
  Gene Symbol: ARHGAP32
  Gene Name: Rho GTPase activating protein 32
  ENSP ID: ENSP00000432303
MKSSVHSEEDDFVPELHRNVHPRERPDWEETLSAMARGADVPEIPGDLTLKTCGSTASMKVKHVKKSTTPGLMGCDNIHRLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTL

SEQ ID NO: 73352 - protein, 946 aa, Homo sapiens
  Payload ID: 14520
  Gene Symbol: ARHGAP32
  Gene Name: Rho GTPase activating protein 32
  ENSP ID: ENSP00000432468
MARGADVPEIPGDLTLKTCGSTASMKVKHVKKLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTLKDSPESVTQMLMAYLSRLSAIAGNKINCGPALTWMEIDNKGNHLLVHEESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGTVCFPPFFL

SEQ ID NO: 73353 - protein, 1738 aa, Homo sapiens; identical to SEQ ID NO: 73350
  Payload ID: 14520
  Gene Symbol: ARHGAP32
  Gene Name: Rho GTPase activating protein 32
  Uniprot ID: A7KAX9
  ENSP ID: ENSP00000432862

SEQ ID NO: 73354 - protein, 748 aa, Homo sapiens
  Payload ID: 14521
  Gene Symbol: ARHGAP33
  Gene Name: Rho GTPase activating protein 33
  ENSP ID: ENSP00000007510
MVARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRYPTPSWSLHSEGQTRSYC

SEQ ID NO: 73355 - protein, 1126 aa, Homo sapiens
  Payload ID: 14521
  Gene Symbol: ARHGAP33
  Gene Name: Rho GTPase activating protein 33
  Uniprot ID: O14559
  ENSP ID: ENSP00000320038
MVARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 73356 - protein, 1123 aa, Homo sapiens
  Payload ID: 14521
  Gene Symbol: ARHGAP33
  Gene Name: Rho GTPase activating protein 33
  Uniprot ID: O14559
  ENSP ID: ENSP00000368227
MLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 73357 - protein, 98 aa, Homo sapiens
  Payload ID: 14521
  Gene Symbol: ARHGAP33
  Gene Name: Rho GTPase activating protein 33
  ENSP ID: ENSP00000465411
MVARSTDSLDGPGEGSVQPLPTAGGPSVKGKPGKRLSAPRGPFPRLADCAHFHYENVDFGHIQLLLSPDREGPSLSGENELVFGVQVTCQCEIIKAAG

SEQ ID NO: 73358 - protein, 863 aa, Homo sapiens
  Payload ID: 14521
  Gene Symbol: ARHGAP33
  Gene Name: Rho GTPase activating protein 33
  ENSP ID: ENSP00000466443
  MOD_RES (1)..(1): Any amino acid
XHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 73359 - protein, 662 aa, Homo sapiens
  Payload ID: 14521
  Gene Symbol: ARHGAP33
  Gene Name: Rho GTPase activating protein 33
  ENSP ID: ENSP00000467844
  MOD_RES (1)..(1): Any amino acid
XHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQEPPACPDLCTGMGGQLLPFFPHMPH

SEQ ID NO: 73360 - protein, 1499 aa, Homo sapiens
  Payload ID: 14522
  Gene Symbol: ARHGAP35
  Gene Name: Rho GTPase activating protein 35
  Uniprot ID: Q9NRY4
  ENSP ID: ENSP00000385720
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKALQKLQAERDALILKHIHFVYHPTKETCPSCPACVDAKIEHLISSRFIRPSDRNQKNSLSDPNIDRINLVILGKDGLARELANEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 73361 - protein, 749 aa, Homo sapiens
  Payload ID: 14522
  Gene Symbol: ARHGAP35
  Gene Name: Rho GTPase activating protein 35
  ENSP ID: ENSP00000479487
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKALQKLQAERDALILKHIHFVYHPTKETCPSCPACVDAKIEHLISSRFIRPSDRNQKNSLSDPNIDRINLVILGKDGLARELANEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGAADLSWLGPI

SEQ ID NO: 73362 - protein, 1499 aa, Homo sapiens; identical to SEQ ID NO: 73360
  Payload ID: 14522
  Gene Symbol: ARHGAP35
  Gene Name: Rho GTPase activating protein 35
  Uniprot ID: Q9NRY4
  ENSP ID: ENSP00000483730

SEQ ID NO: 73363 - protein, 547 aa, Homo sapiens
  Payload ID: 14523
  Gene Symbol: ARHGAP36
  Gene Name: Rho GTPase activating protein 36
  Uniprot ID: Q6ZRI8
  ENSP ID: ENSP00000276211
MGGCIPFLKAARALCPRIMPPLLLLSAFIFLVSVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 73364 - protein, 411 aa, Homo sapiens
  Payload ID: 14523
  Gene Symbol: ARHGAP36
  Gene Name: Rho GTPase activating protein 36
  Uniprot ID: Q6ZRI8
  ENSP ID: ENSP00000359959
MQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 73365 - protein, 535 aa, Homo sapiens
  Payload ID: 14523
  Gene Symbol: ARHGAP36
  Gene Name: Rho GTPase activating protein 36
  Uniprot ID: Q6ZRI8
  ENSP ID: ENSP00000359960
MAWILDCLFASAFEPRPRRVSVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 73366 - protein, 516 aa, Homo sapiens
  Payload ID: 14523
  Gene Symbol: ARHGAP36
  Gene Name: Rho GTPase activating protein 36
  Uniprot ID: Q6ZRI8
  ENSP ID: ENSP00000408515
MSVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 73367 - protein, 218 aa, Homo sapiens
  Payload ID: 14523
  Gene Symbol: ARHGAP36
  Gene Name: Rho GTPase activating protein 36
  ENSP ID: ENSP00000409218
MVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRV

SEQ ID NO: 73368 - protein, 1083 aa, Homo sapiens
  Payload ID: 14524
  Gene Symbol: ARHGAP39
  Gene Name: Rho GTPase activating protein 39
  Uniprot ID: Q9C0H5
  ENSP ID: ENSP00000276826
MSQTQDYECRSHNVDLPESRIPGSNTRLEWVEIIEPRTRERMYANLVTGECVWDPPAGVRIKRTSENQWWELFDPNTSRFYYYNASTQRTVWHRPQGCDIIPLAKLQTLKQNTESPRASAESSPGRGSSVSREGSTSSSLEPEPDTEKAQELPARAGRPAAFGTVKEDSGSSSPPGVFLEKDYEIYRDYSADGQLLHYRTSSLRWNSGAKERMLIKVADREPSFLAAQGNGYAPDGPPGVRSRRPSGSQHSPSLQTFAPEADGTIFFPERRPSPFLKRAELPGSSSPLLAQPRKPSGDSQPSSPRYGYEPPLYEEPPVEYQAPIYDEPPMDVQFEAGGGYQAGSPQRSPGRKPRPFLQPNKQGPPSPCQQLVLTKQKCPERFLSLEYSPAGKEYVRQLVYVEQAGSSPKLRAGPRHKYAPNPGGGSYSLQPSPCLLRDQRLGVKSGDYSTMEGPELRHSQPPTPLPQAQEDAMSWSSQQDTLSSTGYSPGTRKRKSRKPSLCQATSATPTEGPGDLLVEQPLAEEQPPCGTSLAPVKRAEGEAEGARGAAEPFLAQARLAWEAQQAHFHMKQRSSWDSQQDGSGYESDGALPLPMPGPVVRAFSEDEALAQQENRHWRRGTFEKLGFPQILLEKSVSVQTNLASPEPYLHPSQSEDLAACAQFESSRQSRSGVPSSSCVFPTFTLRKPSSETDIENWASKHFNKHTQGLFRRKVSIANMLAWSSESIKKPMIVTSDRHVKKEACELFKLIQMYMGDRRAKADPLHVALEVATKGWSVQGLRDELYIQLCRQTTENFRLESLARGWELMAICLAFFPPTPKFHSYLEGYIYRHMDPVNDTKGVAISTYAKYCYHKLQKAALTGAKKGLKKPNVEEIRHAKNAVFSPSMFGSALQEVMGMQRERYPERQLPWVQTRLSEEVLALNGDQTEGIFRVPGDIDEVNALKLQVDQWKVPTGLEDPHVPASLLKLWYRELEEPLIPHEFYEQCIAHYDSPEAAVAVVHALPRINRMVLCYLIRFLQVFVQPANVAVTKMDVSNLAMVMAPNCLRCQSDDPRVIFENTRKEMSFLRVLIQHLDTSFMEGVL

SEQ ID NO: 73369 - protein, 1114 aa, Homo sapiens
  Payload ID: 14524
  Gene Symbol: ARHGAP39
  Gene Name: Rho GTPase activating protein 39
  Uniprot ID: Q9C0H5
  ENSP ID: ENSP00000366522
MSQTQDYECRSHNVDLPESRIPGSNTRLEWVEIIEPRTRERMYANLVTGECVWDPPAGVRIKRTSENQWWELFDPNTSRFYYYNASTQRTVWHRPQGCDIIPLAKLQTLKQNTESPRASAESSPGRGSSVSREGSTSSSLEPEPDTEKAQELPARAGRPAAFGTVKEDSGSSSPPGVFLEKDYEIYRDYSADGQLLHYRTSSLRWNSGAKERMLIKVADREPSFLAAQGNGYAPDGPPGVRSRRPSGSQHSPSLQTFAPEADGTIFFPERRPSPFLKRAELPGSSSPLLAQPRKPSGDSQPSSPRYGYEPPLYEEPPVEYQAPIYDEPPMDVQFEAGGGYQAGSPQRSPGRKPRPFLQPNKQGPPSPCQQLVLTKQKCPERFLSLEYSPAGKEYVRQLVYVEQAGSSPKLRAGPRHKYAPNPGGGSYSLQPSPCLLRDQRLGVKSGDYSTMEGPELRHSQPPTPLPQAQEDAMSWSSQQDTLSSTGYSPGTRKRKSRKPSLCQATSATPTEGPGDLLVEQPLAEEQPPCGTSLAPVKRAEGEAEGARGAAEPFLAQARLAWEAQQAHFHMKQRSSWDSQQDGSGYESDGALPLPMPGPVVRAFSEDEALAQQENRHWRRGTFEKLGFPQILLEKSVSVQTNLASPEPYLHPSQSEDLAACAQFESSRQSRSGVPSSSCVFPTFTLRKPSSETDIENWASKHFNKHTQGLFRRKVSIANMLAWSSESIKKPMIVTSDRHVKKEACELFKLIQMYMGDRRAKADPLHVALEVATKGWSVQGLRDELYIQLCRQTTENFRLESLARGWELMAICLAFFPPTPKFHSYLEGYIYRHMDPVNDTKVTQHIKELLERNTKKKSKLRKKPKPYVEEPDGVAISTYAKYCYHKLQKAALTGAKKGLKKPNVEEIRHAKNAVFSPSMFGSALQEVMGMQRERYPERQLPWVQTRLSEEVLALNGDQTEGIFRVPGDIDEVNALKLQVDQWKVPTGLEDPHVPASLLKLWYRELEEPLIPHEFYEQCIAHYDSPEAAVAVVHALPRINRMVLCYLIRFLQVFVQPANVAVTKMDVSNLAMVMAPNCLRCQSDDPRVIFENTRKEMSFLRVLIQHLDTSFMEGVL

SEQ ID NO: 73370 - protein, 946 aa, Homo sapiens
  Payload ID: 14525
  Gene Symbol: ARHGAP4
  Gene Name: Rho GTPase activating protein 4
  Uniprot ID: P98171
  ENSP ID: ENSP00000203786
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 73371 - protein, 925 aa, Homo sapiens
  Payload ID: 14525
  Gene Symbol: ARHGAP4
  Gene Name: Rho GTPase activating protein 4
  ENSP ID: ENSP00000359033
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 73372 - protein, 986 aa, Homo sapiens
  Payload ID: 14525
  Gene Symbol: ARHGAP4
  Gene Name: Rho GTPase activating protein 4
  Uniprot ID: P98171
  ENSP ID: ENSP00000359045
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKLWPPQRPVAASSCAPVCWLQAGFLVHPPWWGAMCAPSTHQRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 73373 - protein, 768 aa, Homo sapiens
  Payload ID: 14525
  Gene Symbol: ARHGAP4
  Gene Name: Rho GTPase activating protein 4
  ENSP ID: ENSP00000377322
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 73374 - protein, 217 aa, Homo sapiens
  Payload ID: 14525
  Gene Symbol: ARHGAP4
  Gene Name: Rho GTPase activating protein 4
  ENSP ID: ENSP00000385042
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTHHLALGLPAGQEDVPGISHGERECRGQAPGGRAAGGEAGRPECPHHHRWCH

SEQ ID NO: 73375 - protein, 625 aa, Homo sapiens
  Payload ID: 14525
  Gene Symbol: ARHGAP4
  Gene Name: Rho GTPase activating protein 4
  ENSP ID: ENSP00000397533
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGEDPLVEGCTAHDLDSVAGVLKLYFRSLEPPLFPPDLFGELLASSGTPSWRAWGRTMSRSWKPRCPHRRMTWRGSWRLWPALPTRAAQPRS

SEQ ID NO: 73376 - protein, 214 aa, Homo sapiens
  Payload ID: 14525
  Gene Symbol: ARHGAP4
  Gene Name: Rho GTPase activating protein 4
  ENSP ID: ENSP00000398019
EKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEETSPSTESLKSTSSDPGSRQAGRRRGQQQETETFYLTKLQEYLSGRSILAKLQAKHEKLQEA

SEQ ID NO: 73377 - protein, 176 aa, Homo sapiens
  Payload ID: 14525
  Gene Symbol: ARHGAP4
  Gene Name: Rho GTPase activating protein 4
  ENSP ID: ENSP00000398259
MRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRS

SEQ ID NO: 73378 - protein, 293 aa, Homo sapiens
  Payload ID: 14525
  Gene Symbol: ARHGAP4
  Gene Name: Rho GTPase activating protein 4
  ENSP ID: ENSP00000408656
  MOD_RES (1)..(1): Any amino acid
XKFQKSRQPRPSSQYNQRLFGGDMEKFIQSSGQPVPLVVESCIRFINLNGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPA

SEQ ID NO: 73379 - protein, 196 aa, Homo sapiens
  Payload ID: 14525
  Gene Symbol: ARHGAP4
  Gene Name: Rho GTPase activating protein 4
  ENSP ID: ENSP00000411712
  MOD_RES (1)..(1): Any amino acid
XSHIAEDVGRLVKKAKKTYQAYHMESVNAEAKLREAERQEEKRAGRSVPTTTAGATEAGPLRKSSLKKGGRLVEKLWPPQRPVAASSCAPVCWLQAGFLVHPPWWGAMCAPSTHQRQAKFMEHKLKCTKARNEYLLSLASVNAAVSNYYLHDVLDLMDCCDTGFHLALGQVLRSYTAAESRTQASQVQGLGSLEEA

SEQ ID NO: 73380 - protein, 249 aa, Homo sapiens
  Payload ID: 14525
  Gene Symbol: ARHGAP4
  Gene Name: Rho GTPase activating protein 4
  ENSP ID: ENSP00000412437
  MOD_RES (1)..(1): Any amino acid
XLAPSTQFPAPGMGGHPGGAGEDAQCPPAPCPPTGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNQDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEG

SEQ ID NO: 73381 - protein, 174 aa, Homo sapiens
  Payload ID: 14525
  Gene Symbol: ARHGAP4
  Gene Name: Rho GTPase activating protein 4
  ENSP ID: ENSP00000413782
MRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAG

SEQ ID NO: 73382 - protein, 317 aa, Homo sapiens
  Payload ID: 14525
  Gene Symbol: ARHGAP4
  Gene Name: Rho GTPase activating protein 4
  ENSP ID: ENSP00000473840
MRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPH

SEQ ID NO: 73383 - protein, 277 aa, Homo sapiens
  Payload ID: 14525
  Gene Symbol: ARHGAP4
  Gene Name: Rho GTPase activating protein 4
  ENSP ID: ENSP00000473936
MRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQ

SEQ ID NO: 73384 - protein, 592 aa, Homo sapiens
  Payload ID: 14526
  Gene Symbol: ARHGAP40
  Gene Name: Rho GTPase activating protein 40
  ENSP ID: ENSP00000243967
  MOD_RES (1)..(1): Any amino acid
XGEAESQWLQDTGLSGLLGGLGLDGDHQELLSTLTQTQVAAVCRRLDIYARSVRRQHKTPVRDVRDVFGVFNSGKMSSENGDSGMKGAQLSSGASKFPPAAEPGGLQEQAGREEAFNMDSAYSEQAAVLLQRSRPSRGGTSAWGKCSLPKFTVPKGRLGVTRIGDLSLQDMRKVPSLALIELTALCDILGLDLKRSKAGKWKAAETRLFGVPLDSLLEADHKVLPSTQVPLVLQALLSCLEKRGLDMEGILRVPGSQARVKGLEQKLERDFYAGLFSWDEVHHNDASDLLKRFIRKLPTPLLTAEYLPAFAVVPNIPNLKQRLQVLHLLILILPEPNRNALKALLEFLRKVVAREQHNKMTLRNVSTVMAPNLFLHQGRPPKLPKGKEKQLAEGAAEVVQIMVHYQDLLWTVASFLVAQVRKLNDSSSRRPQLCDAGLKTWLRRMHADRDKAGDGLEATPKVAKIQVVWPIKDPLKVPLTPSTKVAHVLRQFTEHLSPGSKGQEDSEDMDSLLLHHRSMESANILLYEVGGNINEHRLDPDAYLLDLYRANPHGKIVSKVALQCVVAAAPETKPGELCDLGQAPCPLRILSG

SEQ ID NO: 73385 - protein, 622 aa, Homo sapiens
  Payload ID: 14526
  Gene Symbol: ARHGAP40
  Gene Name: Rho GTPase activating protein 40
  Uniprot ID: Q5TG30
  ENSP ID: ENSP00000362442
MDQLPQKNLLRLHPAGSAGCSTGVESSSMDGFWMEVEQIQQRDELREEDSGGNEGQLPEEGEAESQWLQDTGLSGLLGGLGLDGDHQELLSTLTQTQVAAVCRRLDIYARSVRRQHKTPVRDVRDVFGVFNSGKMSSENGDSGMKGAQLSSGASKFPPAAEPGGLQEQAGREEAFNMDSAYSEQAAVLLQRSRPSRGGTSAWGKCSLPKFTVPKGRLGVTRIGDLSLQDMRKVPSLALIELTALCDILGLDLKRSKAGKWKAAETRLFGVPLDSLLEADHKVLPSTQVPLVLQALLSCLEKRGLDMEGILRVPGSQARVKGLEQKLERDFYAGLFSWDEVHHNDASDLLKRFIRKLPTPLLTAEYLPAFAVVPNIPNLKQRLQVLHLLILILPEPNRNALKALLEFLRKVVAREQHNKMTLRNVSTVMAPNLFLHQGRPPKLPKGKEKQLAEGAAEVVQIMVHYQDLLWTVASFLVAQVRKLNDSSSRRPQLCDAGLKTWLRRMHADRDKAGDGLEATPKVAKIQVVWPIKDPLKVPLTPSTKVAHVLRQFTEHLSPGSKGQEDSEDMDSLLLHHRSMESANILLYEVGGNINEHRLDPDAYLLDLYRANPHGEWVLKQNPT

SEQ ID NO: 73386 - protein, 154 aa, Homo sapiens
  Payload ID: 14526
  Gene Symbol: ARHGAP40
  Gene Name: Rho GTPase activating protein 40
  ENSP ID: ENSP00000362443
  MOD_RES (1)..(1): Any amino acid
XTVASFLVAQVRKLNDSSSRRPQLCDAGLKTWLRRMHADRDKAGDGLEATPKVAKIQVVWPIKDPLKVPLTPSTKVAHVLRQFTEHLSPGSKGQEDSEDMDSLLLHHRSMESANILLYEVGGNINEHRLDPDAYLLDLYRANPHGEWVLKQNPT

SEQ ID NO: 73387 - protein, 72 aa, Homo sapiens
  Payload ID: 14526
  Gene Symbol: ARHGAP40
  Gene Name: Rho GTPase activating protein 40
  ENSP ID: ENSP00000414822
  MOD_RES (1)..(1): Any amino acid
XHLSPGSKGQEDSEDMDSLLLHHRSMESANILLYEVGGNINEHRLDPDAYLLDLYRANPHVQCSVGVVLPAS

SEQ ID NO: 73388 - protein, 874 aa, Homo sapiens
  Payload ID: 14527
  Gene Symbol: ARHGAP42
  Gene Name: Rho GTPase activating protein 42
  Uniprot ID: A6NI28
  ENSP ID: ENSP00000298815
MGLPTLEFSDSYLDSPDFRERLQCHEIELERTNKFIKELIKDGSLLIGALRNLSMAVQKFSQSLQDFQFECIGDAETDDEISIAQSLKEFARLLIAVEEERRRLIQNANDVLIAPLEKFRKEQIGAAKDGKKKFDKESEKYYSILEKHLNLSAKKKESHLQEADTQIDREHQNFYEASLEYVFKIQEVQEKKKFEFVEPLLSFLQGLFTFYHEGYELAQEFAPYKQQLQFNLQNTRNNFESTRQEVERLMQRMKSANQDYRPPSQWTMEGYLYVQEKRPLGFTWIKHYCTYDKGSKTFTMSVSEMKSSGKMNGLVTSSPEMFKLKSCIRRKTDSIDKRFCFDIEVVERHGIITLQAFSEANRKLWLEAMDGKEPIYTLPAIISKKEEMYLNEAGFNFVRKCIQAVETRGITILGLYRIGGVNSKVQKLMNTTFSPKSPPDIDIDIELWDNKTITSGLKNYLRCLAEPLMTYKLHKDFIIAVKSDDQNYRVEAVHALVHKLPEKNREMLDILIKHLVKVSLHSQQNLMTVSNLGVIFGPTLMRAQEETVAAMMNIKFQNIVVEILIEHYEKIFHTAPDPSIPLPQPQSRSGSRRTRAICLSTGSRKPRGRYTPCLAEPDSDSYSSSPDSTPMGSIESLSSHSSEQNSTTKSASCQPREKSGGIPWIATPSSSNGQKSLGLWTTSPESSSREDATKTDAESDCQSVASVTSPGDVSPPIDLVKKEPYGLSGLKRASASSLRSISAAEGNKSYSGSIQSLTSVGSKETPKASPNPDLPPKMCRRLRLDTASSNGYQRPGSVVAAKAQLFENVGSPKPVSSGRQAKAMYSCKAEHSHELSFPQGAIFSNVYPSVEPGWLKATYEGKTGLVPENYVVFL

SEQ ID NO: 73389 - protein, 840 aa, Homo sapiens
  Payload ID: 14527
  Gene Symbol: ARHGAP42
  Gene Name: Rho GTPase activating protein 42
  ENSP ID: ENSP00000431776
MGLPTLEFSDSYLDSPDFRERLQCHEIELERTNKFIKELIKDGSLLIGALRNLSMAVQKFSQSLQDFQFECIGDAETDDEISIAQSLKEFARLLIAVEEERRRLIQNANDVLIAPLEKFRKEQIGAAKADTQIDREHQNFYEASLEYVFKIQEVQEKKKFEFVEPLLSFLQGLFTFYHEGYELAQEFAPYKQQLQFNLQNTRNNFESTRQEVERLMQRMKSANQDYRPPSQWTMEGYLYVQEKRPLGFTWIKHYCTYDKGSKTFTMSVSEMKSSGKMNGLVTSSPEMFKLKSCIRRKTDSIDKRFCFDIEVVERHGIITLQAFSEANRKLWLEAMDGKEPIYTLPAIISKKEEMYLNEAGFNFVRKCIQAVETRGITILGLYRIGGVNSKVQKLMNTTFSPKSPPDIDIDIELWDNKTITSGLKNYLRCLAEPLMTYKLHKDFIIAVKSDDQNYRVEAVHALVHKLPEKNREMLDILIKHLVKVSLHSQQNLMTVSNLGVIFGPTLMRAQEETVAAMMNIKFQNIVVEILIEHYEKIFHTAPDPSIPLPQPQSRSGSRRTRAICLSTGSRKPRGRYTPCLAEPDSDSYSSSPDSTPMGSIESLSSHSSEQNSTTKSASCQPREKSGGIPWIATPSSSNGQKSLGLWTTSPESSSREDATKTDAESDCQSVASVTSPGDVSPPIDLVKKEPYGLSGLKRASASSLRSISAAEGNKSYSGSIQSLTSVGSKETPKASPNPDLPPKMCRRLRLDTASSNGYQRPGSVVAAKAQLFENVGSPKPVSSGRQAKAMYSCKAEHSHELSFPQGAIFSNVYPSVEPGWLKATYEGKTGLVPENYVVFL

SEQ ID NO: 73390 - protein, 230 aa, Homo sapiens
  Payload ID: 14527
  Gene Symbol: ARHGAP42
  Gene Name: Rho GTPase activating protein 42
  ENSP ID: ENSP00000434304
LEKHLNLSAKKKESHLQEADTQIDREHQNFYEASLEYVFKIQEVQEKKKFEFVEPLLSFLQGLFTFYHEGYELAQEFAPYKQQLQFNLQNTRNNFESTRQEVERLMQRMKSANQDYRPPSQWTMEGYLYVQEKRPLGFTWIKHYCTYDKGSKTFTMSVSEMKSSGKMNGLVTSSPEMFKLKSCIRRKTDSIDKRFCFDIEVVERHGIITLQAFSEANRKLWLEAMDGKEP

SEQ ID NO: 73391 - protein, 443 aa, Homo sapiens
  Payload ID: 14527
  Gene Symbol: ARHGAP42
  Gene Name: Rho GTPase activating protein 42
  ENSP ID: ENSP00000435961
  MOD_RES (1)..(1): Any amino acid
XTPNAISLLFSVYLNEAGFNFVRKCIQAVETRGITILGLYRIGGVNSKVQKLMNTTFSPKSPPDIDIDIELWDNKTITSGLKNYLRCLAEPLMTYKLHKDFIIAVKSDDQNYRVEAVHALVHKLPEKNREMLDILIKHLVKVSLHSQQNLMTVSNLGVIFGPTLMRAQEETVAAMMNIKFQNIVVEILIEHYEKIFHTAPDPSIPLPQPQSRSGSRRTRAICLSTGSRKPRGRYTPCLAEPDSDSYSSSPDSTPMGSIESLSSHSSEQNSTTKSASCQPREKSGGIPWIATPSSSNGQKSLGLWTTSPESSSREDATKTDAESDCQSVASVTSPGDVSPPIDLVKKEPYGLSGLKRASASSLRSISAAEGNKSYSGSIQSLTSVGSKETPKASPNPDLPPKMCRRLRLDTASSNGYQRPGSVVAAKAQLFENVGSPKPVSSGR

SEQ ID NO: 73392 - protein, 774 aa, Homo sapiens
  Payload ID: 14528
  Gene Symbol: ARHGAP44
  Gene Name: Rho GTPase activating protein 44
  ENSP ID: ENSP00000262444
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGLRKIQSMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTAV

SEQ ID NO: 73393 - protein, 812 aa, Homo sapiens
  Payload ID: 14528
  Gene Symbol: ARHGAP44
  Gene Name: Rho GTPase activating protein 44
  Uniprot ID: Q17R89
  ENSP ID: ENSP00000342566
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTDLVHFDIPSIHIELGSTLRLSPLEHMRRHSVTDKRDSEEESESTAL

SEQ ID NO: 73394 - protein, 818 aa, Homo sapiens
  Payload ID: 14528
  Gene Symbol: ARHGAP44
  Gene Name: Rho GTPase activating protein 44
  Uniprot ID: Q17R89
  ENSP ID: ENSP00000368994
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGLRKIQSMGVRVMDTNWVARRGSSAGRKVSCAPPSMQPPAPPAELAAPLPSPLPEQPLDSPAAPALSPSGLGLQPGPERTSTTKSKELSPGSAQKGSPGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTDLVHFDIPSIHIELGSTLRLSPLEHMRRHSVTDKRDSEEESESTAL

SEQ ID NO: 73395 - protein, 591 aa, Homo sapiens
  Payload ID: 14528
  Gene Symbol: ARHGAP44
  Gene Name: Rho GTPase activating protein 44
  ENSP ID: ENSP00000437542
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRWQQTSKSSGLSSSLQPAGAKADALREEMEEAANRVEICRDQLSADMYSFVAKEIDYANYFQTLIEVQAEYHRKSLTLLQAVLPQIKAQQEAWVEKPSFGKPLEEHLTISGREIAFPIEACVTMLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFLSKLSEYQDVNKMTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGFKEAGTDSTQGPLWPAGGYGRPVRWPAVPSQPVPHPAQHPVTLWTELPSGVLLGLGPALPSCSSSPGLSFCLYKHFEQIAAHS

SEQ ID NO: 73396 - protein, 178 aa, Homo sapiens
  Payload ID: 14528
  Gene Symbol: ARHGAP44
  Gene Name: Rho GTPase activating protein 44
  ENSP ID: ENSP00000462141
MKKQFNRMRQLANQTVGRAEKTEVLSEDLLQVEKRLELVKQVSHSTHKKLTACLQGQQGAEADKRSKKLPLTTLAQCLMEGSAILGDDTLLGKMLKLCGETEDKLAQELIHFELQVERDVIEPLFLLAEVEIPNIQKQRKHLAKLVLDMDSSRTRTSSQLICTVLWPKKLTMQTTFKR

SEQ ID NO: 73397 - protein, 191 aa, Homo sapiens
  Payload ID: 14528
  Gene Symbol: ARHGAP44
  Gene Name: Rho GTPase activating protein 44
  ENSP ID: ENSP00000463905
MTPSNMAIVLGPNLLWPQAEGNITEMMTTVSLQIVGIIEPIIQHADWFFPGEIEFNITGNYGSPVHVNHNANYSSMPSPDMDPADRRQPEQARRPLSVATDNMMLEFYKKDGLRKIQSMGVRVMDTNWVARRGSSAGRKVSCAPPSMQPPAPPAELAAPLPSPLPEQPLDSPAAPALSPSGLGLQPGPERT

SEQ ID NO: 73398 - protein, 182 aa, Homo sapiens
  Payload ID: 14528
  Gene Symbol: ARHGAP44
  Gene Name: Rho GTPase activating protein 44
  ENSP ID: ENSP00000465509
  MOD_RES (1)..(1): Any amino acid
XGSSQGTACAGTQPGAQPGAQPGASPSPSQPPADQSPHTLRKVSKKLAPIPPKVPFGQPGAMADQSAGQPSPVSLSPTPPSTPSPYGLSYPQGYSLASGQLSPAAAPPLASPSVFTSTLSKSRPTPKPRQRPTLPPPQPPTVNLSASSPQSTEAPMLDGMSPGESMSTGNQATGSLTFFYEL

SEQ ID NO: 73399 - protein, 116 aa, Homo sapiens
  Payload ID: 14528
  Gene Symbol: ARHGAP44
  Gene Name: Rho GTPase activating protein 44
  ENSP ID: ENSP00000482851
MLLECGMQEEGLFRVAPSASKLKKLKAALDCCVVDVQEYSADPHAIAGALKSYLRELPEPLMTFELYDEWIQASNVQEQDKKLQALWNACEKLPKANHNNIRYLIKFYPSCQNIKM

SEQ ID NO: 73400 - protein, 1502 aa, Homo sapiens
  Payload ID: 14529
  Gene Symbol: ARHGAP5
  Gene Name: Rho GTPase activating protein 5
  Uniprot ID: Q13017
  ENSP ID: ENSP00000371897
MMAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVDHYLREVQAFASNKKNLLVVETSARFNVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKQKKKTKNFNPPTRRNWESNYFGMPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 73401 - protein, 237 aa, Homo sapiens
  Payload ID: 14529
  Gene Symbol: ARHGAP5
  Gene Name: Rho GTPase activating protein 5
  Uniprot ID: Q13017
  ENSP ID: ENSP00000379827
MSLPPPPPGPLPLRRRRRRPTLLGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 73402 - protein, 1498 aa, Homo sapiens [sequence omitted]

SEQ ID NO: 73403 - protein, 241 aa, Homo sapiens
  Payload ID: 14529
  Gene Symbol: ARHGAP5
  Gene Name: Rho GTPase activating protein 5
  Uniprot ID: Q13017
  ENSP ID: ENSP00000407395
MPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 73404 - protein, 1502 aa, Homo sapiens; identical to SEQ ID NO: 73400
  Payload ID: 14529
  Gene Symbol: ARHGAP5
  Gene Name: Rho GTPase activating protein 5
  Uniprot ID: Q13017
  ENSP ID: ENSP00000441692

SEQ ID NO: 73405 - protein, 137 aa, Homo sapiens
  Payload ID: 14529
  Gene Symbol: ARHGAP5
  Gene Name: Rho GTPase activating protein 5
  ENSP ID: ENSP00000451061
MPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQ

SEQ ID NO: 73406 - protein, 140 aa, Homo sapiens
  Payload ID: 14529
  Gene Symbol: ARHGAP5
  Gene Name: Rho GTPase activating protein 5
  ENSP ID: ENSP00000451579
MMAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGL

SEQ ID NO: 73407 - protein, 1501 aa, Homo sapiens
  Payload ID: 14529
  Gene Symbol: ARHGAP5
  Gene Name: Rho GTPase activating protein 5
  Uniprot ID: Q13017
  ENSP ID: ENSP00000452222
MMAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVDHYLREVQAFASNKKNLLVVETSARFNVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKKKKTKNFNPPTRRNWESNYFGMPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 73408 - protein, 37 aa, Homo sapiens
  Payload ID: 14529
  Gene Symbol: ARHGAP5
  Gene Name: Rho GTPase activating protein 5
  ENSP ID: ENSP00000452372
MMAKNKEPRPPSYTISIVGLSGTEKDKGNCGVGKSCL

SEQ ID NO: 73409 - protein, 148 aa, Homo sapiens
  Payload ID: 14529
  Gene Symbol: ARHGAP5
  Gene Name: Rho GTPase activating protein 5
  ENSP ID: ENSP00000452606
  MOD_RES (1)..(1): Any amino acid
XSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKGYVPKDSTVSAGIKLTKTIFKSSLIKIIISI

SEQ ID NO: 73410 - protein, 771 aa, Homo sapiens
  Payload ID: 14530
  Gene Symbol: ARHGAP6
  Gene Name: Rho GTPase activating protein 6
  Uniprot ID: O43182
  ENSP ID: ENSP00000302312
MSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 73411 - protein, 974 aa, Homo sapiens
  Payload ID: 14530
  Gene Symbol: ARHGAP6
  Gene Name: Rho GTPase activating protein 6
  Uniprot ID: O43182
  ENSP ID: ENSP00000338967
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 73412 - protein, 601 aa, Homo sapiens
  Payload ID: 14530
  Gene Symbol: ARHGAP6
  Gene Name: Rho GTPase activating protein 6
  ENSP ID: ENSP00000370093
LELYDLQILGTKPPMNSDTHRNFDPTATLRNQGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 73413 - protein, 765 aa, Homo sapiens
  Payload ID: 14530
  Gene Symbol: ARHGAP6
  Gene Name: Rho GTPase activating protein 6
  Uniprot ID: O43182
  ENSP ID: ENSP00000370094
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 73414 - protein, 771 aa, Homo sapiens; identical to SEQ ID NO: 73410
  Payload ID: 14530
  Gene Symbol: ARHGAP6
  Gene Name: Rho GTPase activating protein 6
  Uniprot ID: O43182
  ENSP ID: ENSP00000370112

SEQ ID NO: 73415 - protein, 690 aa, Homo sapiens
  Payload ID: 14530
  Gene Symbol: ARHGAP6
  Gene Name: Rho GTPase activating protein 6
  Uniprot ID: O43182
  ENSP ID: ENSP00000435767
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSELELYDLQILGTKPPMNSDTHRNFDPTATLRNQGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSTSSVLPAAVQACPQYPASMFTP

SEQ ID NO: 73416 - protein, 305 aa, Homo sapiens
  Payload ID: 14531
  Gene Symbol: ARHGAP8
  Gene Name: Rho GTPase activating protein 8
  Uniprot ID: P85298
  ENSP ID: ENSP00000337287
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVPGEHLQQNEQL

SEQ ID NO: 73417 - protein, 433 aa, Homo sapiens
  Payload ID: 14531
  Gene Symbol: ARHGAP8
  Gene Name: Rho GTPase activating protein 8
  Uniprot ID: P85298
  ENSP ID: ENSP00000348407
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 73418 - protein, 28 aa, Homo sapiens
  Payload ID: 14531
  Gene Symbol: ARHGAP8
  Gene Name: Rho GTPase activating protein 8
  ENSP ID: ENSP00000374422
MAGQDPALSTSHPFYDVARHGILQVAGI

SEQ ID NO: 73419 - protein, 464 aa, Homo sapiens
  Payload ID: 14531
  Gene Symbol: ARHGAP8
  Gene Name: Rho GTPase activating protein 8
  Uniprot ID: P85298
  ENSP ID: ENSP00000374424
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKDGDLTMWPRLVSNSKLKRSSHLSLPKYWDYRYKKNLKALYVVHPTSFIKVLWNILKPLISHKFGKKVIYFNYLSELHEHLKYDQLVIPPEVLRYDEKLQSLHEGRTPPPTKTPPPRPPLPTQQFGVSLQYLKDKNQGELIPPVLRFTVTYLREKGLRTEGLFRRSASVQTVREIQRLYNQGKPVNFDDYGDIHIPAVILKTFLRELPQPLLTFQAYEQILGITCVESSLRVTGCRQILRSLPEHNYVVLRYLMGFLHAVSRESIFNKMNSSNLACVFGLNLIWPSQGVSSLSALVPLNMFTELLIEYYEKIFSTPEAPGEHGLAPWEQGSRAAPLQEAVPRTQATGLTKPTLPPSPLMAARRRL

SEQ ID NO: 73420 - protein, 130 aa, Homo sapiens
  Payload ID: 14531
  Gene Symbol: ARHGAP8
  Gene Name: Rho GTPase activating protein 8
  ENSP ID: ENSP00000379425
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKDGDLTMWPRLVSNSKLKRSSHLSLPKYWDY

SEQ ID NO: 73421 - protein, 115 aa, Homo sapiens
  Payload ID: 14531
  Gene Symbol: ARHGAP8
  Gene Name: Rho GTPase activating protein 8
  ENSP ID: ENSP00000402775
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKYKKNLKALYVVHPTS

SEQ ID NO: 73422 - protein, 163 aa, Homo sapiens
  Payload ID: 14531
  Gene Symbol: ARHGAP8
  Gene Name: Rho GTPase activating protein 8
  ENSP ID: ENSP00000403618
MAGQDPALSTSHPFYDVARHGILQVAGDDRFGRRVVTFSCCRMPPSHELDHQRLLEYLKYTLDQYVENDYTIVYFHYGLNSRNKPSLGWLQSAYKEFDRKDGLTQPPWLTPVIPVLWEAKVQEELEGPLRGAPHQLHQGPVEHLEAPHQSQVWEESHLFQLPE

SEQ ID NO: 73423 - protein, 731 aa, Homo sapiens
  Payload ID: 14532
  Gene Symbol: ARHGAP9
  Gene Name: Rho GTPase activating protein 9
  Uniprot ID: Q9BRR9
  ENSP ID: ENSP00000377380
MLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 73424 - protein, 821 aa, Homo sapiens
  Payload ID: 14532
  Gene Symbol: ARHGAP9
  Gene Name: Rho GTPase activating protein 9
  ENSP ID: ENSP00000377386
MRRGSSDSCASGSQVAGTTVAGPAHPESLTLCSGEAERRGKEEWPDSHHYPGPTPAPESSDGPHKVTVLATMLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLVRWVEARREAPTGRDQGSGDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 73425 - protein, 640 aa, Homo sapiens
  Payload ID: 14532
  Gene Symbol: ARHGAP9
  Gene Name: Rho GTPase activating protein 9
  Uniprot ID: Q9BRR9
  ENSP ID: ENSP00000394307
MLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALG

SEQ ID NO: 73426 - protein, 547 aa, Homo sapiens
  Payload ID: 14532
  Gene Symbol: ARHGAP9
  Gene Name: Rho GTPase activating protein 9
  Uniprot ID: Q9BRR9
  ENSP ID: ENSP00000397950
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 73427 - protein, 174 aa, Homo sapiens
  Payload ID: 14532
  Gene Symbol: ARHGAP9
  Gene Name: Rho GTPase activating protein 9
  ENSP ID: ENSP00000446932
MGEGAGGGKAKRSMGRATGRMTTSFFPLFWQAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPH

SEQ ID NO: 73428 - protein, 142 aa, Homo sapiens
  Payload ID: 14532
  Gene Symbol: ARHGAP9
  Gene Name: Rho GTPase activating protein 9
  ENSP ID: ENSP00000448358
MIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLD

SEQ ID NO: 73429 - protein, 156 aa, Homo sapiens
  Payload ID: 14532
  Gene Symbol: ARHGAP9
  Gene Name: Rho GTPase activating protein 9
  ENSP ID: ENSP00000448404
  MOD_RES (1)..(1): Any amino acid
XEGDTVPSFLRLCIAAVDKRGLDVDGIYRVSGNLAVVQKLRFLVDRERAVTSDGRYVFPEQPGQALSESEQCLSQIQELIGSMPKPNHDTLRYLLEHLCRVIAHSDKNRMTPHNLGIVFGPTLFRPEQETSDPAAHALYPGQLVQLMLTNFTSLFP

SEQ ID NO: 73430 - protein, 168 aa, Homo sapiens
  Payload ID: 14532
  Gene Symbol: ARHGAP9
  Gene Name: Rho GTPase activating protein 9
  ENSP ID: ENSP00000448423
RNKLKRLIAKRPPLQSLQERGLLRDQVFGCQLESLCQREGDTVPSFLRLCIAAVDKRGLDVDGIYRVSGNLAVVQKLRFLVDREGRLDLDSTEWDDIHVVTGALKLFLRELPQPLVPPLLLPHFRAALALSESEQCLSQIQELIGSMPKPNHDTLRYLLEHLCRVIAH

SEQ ID NO: 73431 - protein, 131 aa, Homo sapiens
  Payload ID: 14532
  Gene Symbol: ARHGAP9
  Gene Name: Rho GTPase activating protein 9
  ENSP ID: ENSP00000448424
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQ

SEQ ID NO: 73432 - protein, 296 aa, Homo sapiens
  Payload ID: 14532
  Gene Symbol: ARHGAP9
  Gene Name: Rho GTPase activating protein 9
  ENSP ID: ENSP00000449829
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRS

SEQ ID NO: 73433 - protein, 61 aa, Homo sapiens
  Payload ID: 14532
  Gene Symbol: ARHGAP9
  Gene Name: Rho GTPase activating protein 9
  ENSP ID: ENSP00000450223
MSEPPVYCNLVDLRRCPRSPPPGPACPLLQRLDAWEQHLDPNSGRCFYINSLTGCKSWKPP

SEQ ID NO: 73434 - protein, 152 aa, Homo sapiens
  Payload ID: 14532
  Gene Symbol: ARHGAP9
  Gene Name: Rho GTPase activating protein 9
  ENSP ID: ENSP00000450256
MSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQEVEKSGLLNMTKIAQGGRKLRKNWGPSWVVLTGNSLVFYREPPPTA

SEQ ID NO: 73435 - protein, 736 aa, Homo sapiens
  Payload ID: 14532
  Gene Symbol: ARHGAP9
  Gene Name: Rho GTPase activating protein 9
  ENSP ID: ENSP00000473445
MISAQCNLCLPGSSDSCASGSQVAGTTVAGPAHPESLTLCSGEAERRGKEEWPDSHHYPGPTPAPESSDGPHKVTVLATMLSSRWWPSSWGILGLGPRSPPRGSQLCALYAFTYTGADGQQVSLAEGDRFLLLRKTNSDWWLARRLEAPSTSRPIFVPAAYMIEESIPSQSPTTVIPGQLLWTPGPKLFHGSLEELSQALPSRAQASSEQPPPLPRKMCRSVSTDNLSPSLLKPFQEGPSGRSLSQEDLPSEASASTAGPQPLMSEPPVYCNLVDLRRCPRSPPPGPACPLLQRLDAWEQHLDPNSGRCFYINSLTGCKSWKPPRRSRSETNPGSMEGTQTLKRNNDVLQPQAKGFRSDTGTPEPLDPQGSLSLSQRTSQLDPPALQAPRPLPQLLDDPHEVEKSGLLNMTKIAQGGRKLRKNWGPSWVVLTGNSLVFYREPPPTAPSSGWGPAGSRPESSVDLRGAALAHGRHLSSRRNVLHIRTIPGHEFLLQSDHETELRAWHRALRTVIERLDRENPLELRLSGSGPAELSAGEDEEEESELVSKPLLRLSSRRSSIRGPEGTEQNRVRNKLKRLIAKRPPLQSLQERGLLRDQVFGCQLESLCQREGDTVPSFLRLCIAAVDKRGLDVDGIYRVSGNLAVVQKLRFLVDRERAVTSDGRYVFPEQPGQEGRLDLDSTEWDDIHVVTGALKLFLRELPQPLVPPLLLPHFRAALAVPLSDTRINRLNAKAQP

SEQ ID NO: 73436 - protein, 927 aa, Homo sapiens
  Payload ID: 14533
  Gene Symbol: ARHGEF1
  Gene Name: Rho guanine nucleotide exchange factor (GEF) 1
  Uniprot ID: Q92888
  ENSP ID: ENSP00000337261
MASLSTWSSPAEPREMEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 73437 - protein, 879 aa, Homo sapiens
  Payload ID: 14533
  Gene Symbol: ARHGEF1
  Gene Name: Rho guanine nucleotide exchange factor (GEF) 1
  Uniprot ID: Q92888
  ENSP ID: ENSP00000344429
MEDFARGAASPGPSRPGLVPVSIIGAEDEDFENELETNSEEQNSQFQSLEQVKRRPAHLMALLQHVALQFEPGPLVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 73438 - protein, 912 aa, Homo sapiens
  Payload ID: 14533
  Gene Symbol: ARHGEF1
  Gene Name: Rho guanine nucleotide exchange factor (GEF) 1
  Uniprot ID: Q92888
  ENSP ID: ENSP00000346532
MEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 73439 - protein, 948 aa, Homo sapiens
  Payload ID: 14533
  Gene Symbol: ARHGEF1
  Gene Name: Rho guanine nucleotide exchange factor (GEF) 1
  Uniprot ID: Q92888
  ENSP ID: ENSP00000367394
MASLSTWSSPAEPREMEDFARGAASPGPSRPGLVPVSIIGAEDEDFENELETNSEEQNSQFQSLEQVKRRPAHLMALLQHVALQFEPGPLVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETESPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKGVGGGILPPETPPVSAWGELCPPAWLHLRFPPRKAFCKKERNGGEDVRDHPHPHSCRSISHPEGLRRGSCGPRLGGAQLGLLAPHEPRPSLPPALCLGDSGLHSGGHHGDPGHLSIACGGHPSTPTPKCLRSVFIP

SEQ ID NO: 73440 - protein, 68 aa, Homo sapiens
  Payload ID: 14533
  Gene Symbol: ARHGEF1
  Gene Name: Rho guanine nucleotide exchange factor (GEF) 1
  ENSP ID: ENSP00000469409
  MOD_RES (1)..(1): Any amino acid
XVHVLLLDDLLLLLQRQDERLLLKSHSRTLTPTPDGKTMLRPVLRLTSAMTREVATAGVLSSLRLPDP

SEQ ID NO: 73441 - protein, 702 aa, Homo sapiens
  Payload ID: 14533
  Gene Symbol: ARHGEF1
  Gene Name: Rho guanine nucleotide exchange factor (GEF) 1
  ENSP ID: ENSP00000469735
  MOD_RES (1)..(1): Any amino acid
XGVGMPSRDRNIGAPGQDTPGVSLHPLSLDSPDREPGADAPLELGDSSPQGPMSLESLAPPESTDEGAETERRWKRLSGRLGRSESLRVSDRRRPSRGSLGAKGRGGGRSRSDVDMDPSSATAVLGPARRATPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKGVGGGILPPETPPVSAWGELCPPAWLHLRFPPRKHPILTTTCEVGTAMMDAHFTDVETEVLTGKVTWPKSHRDEVSLDLNAGARWRWRRCVQDPCWTRKPGPGLEHGPAHTQPG

SEQ ID NO: 73442 - protein, 307 aa, Homo sapiens
  Payload ID: 14533
  Gene Symbol: ARHGEF1
  Gene Name: Rho guanine nucleotide exchange factor (GEF) 1
  ENSP ID: ENSP00000470042
  MOD_RES (1)..(1): Any amino acid
XTSVPALVSPRLCPCPGFSSSLFLSWSLLVSVPGICLTLSLASGSRLSGRLGRSESLRVSDRRRPSRGSLGAKGRGGGRSRSDVDMDPSSATAVLGPARRATPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNT

SEQ ID NO: 73443 - protein, 275 aa, Homo sapiens
  Payload ID: 14533
  Gene Symbol: ARHGEF1
  Gene Name: Rho guanine nucleotide exchange factor (GEF) 1
  ENSP ID: ENSP00000470557
FFRKKVMGNRRSDEPAKTKKGLSSILDAARWNRGEPQAEKPGATDRKGGVGMPSRDRNIGAPGQDTPGVSLHPLSLDSPDREPGADAPLELGDSSPQGPMSLESLAPPESTDEGAETERRWKRLSGRLGRSESLRVSDRRRPSRGSLGAKGRGGGRSRSDVDMDPSSATAVLGPARRATPEPGDEGEPGRSGLELEPEEPPGWRELVPPDTLHSLPKSQVKRQEVISELLVTEAAHVRMLRVLHDLFFQPMAECLFFPLEELQNIFPSLDELIEV

SEQ ID NO: 73444 - protein, 968 aa, Homo sapiens
  Payload ID: 14533
  Gene Symbol: ARHGEF1
  Gene Name: Rho guanine nucleotide exchange factor (GEF) 1
  ENSP ID: ENSP00000470715
MEDFARGAASPGPSRPGLVPVSIIGAEDEDFENELETNSEEQNSQFQSLEQVKRRPAHLMALLQHVALQFEPGPLLCCLHADMLGSLGPKEAKKAFLDFYHSFLEKTAVLRVPVPPNVAFELDRTRADLISEDVQRRFVQEVVQSQQVAVGRQLEDFRSKRLMGMTPWEQELAQLEAWVGRDRASYEARERHVAERLLMHLEEMQHTISTDEEKSAAVVNAIGLYMRHLGVRTKSGDKKSGRNFFRKKVMGNRRSDEPAKTKKGLSSILDAARWNRGEPQVPDFRHLKAEVDAEKPGATDRKGGVGMPSRDRNIGAPGQDTPGVSLHPLSLDSPDREPGADAPLELGDSSPQGPMSLESLAPPESTDEGAETERLSGRLGRSESLRVSDRRRPSRGSLGAKGRGGGRSRSDVDMDPSSATAVLGPARRATPEPGDEGEPGRSGLELEPEEPPGWRELVPPDTLHSLPKSQVKRQEVISELLVTEAAHVRMLRVLHDLFFQPMAECLFFPLEELQNIFPSLDELIEVHSLFLDRLMKRRQESGYLIEEIGDVLLARFDGAEGSWFQKISSRFCSRQSFALEQLKAKQRKDPRFCAFVQEAESRPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNWCALITETAGSLKVPAPASRPKPRPSPSSTREPLLSSSENGNGGRETSPADARTERILSDLLPFCRPGPEGQLAATALRKVLSLKQLLFPAEEDNGAGPPRDGDGVPGGGPLSPARTQEIQENLLSLEETMKQLEELEEEFCRLRPLLSQLGGNSVPQPGCT

SEQ ID NO: 73445 - protein, 128 aa, Homo sapiens
  Payload ID: 14533
  Gene Symbol: ARHGEF1
  Gene Name: Rho guanine nucleotide exchange factor (GEF) 1
  ENSP ID: ENSP00000471942
  MOD_RES (1)..(1): Any amino acid
XPILTTTCEVGTAMMDAHFTDVETEVLTGKVTWPKSHRDEVSLDLNAVDARTNGQARGGGGDDASRTPAGHASLDRDWNTDPHTRSLDRRYTDRGTYGYSQAPPRQVPHHLLWGKAALTWAAPGGFYP

SEQ ID NO: 73446 - protein, 291 aa, Homo sapiens
  Payload ID: 14533
  Gene Symbol: ARHGEF1
  Gene Name: Rho guanine nucleotide exchange factor (GEF) 1
  ENSP ID: ENSP00000472466
  MOD_RES (1)..(1): Any amino acid
XPRCRRLQLKDMIPTEMQRLTKYPLLLQSIGQNTEEPTEREKVELAAECCREILHHVNQAVRDMEDLLRLKDYQRRLDLSHLRQSSDPMLSEFKNLDITKKKLVHEGPLTWRVTKDKAVEVHVLLLDDLLLLLQRQDERLLLKSHSRTLTPTPDGKTMLRPVLRLTSAMTREVATDHKAFYVLFTWDQEAQIYELVAQTVSERKNTREPLLSSSENGNGGRETSPADARTERILSDLLPFCRPGPEGQLAATALRKVLSLKQLLFPAEEDNGAGPPRDGDGVPGGGPLSPA

SEQ ID NO: 73447 - protein, 88 aa, Homo sapiens
  Payload ID: 14533
  Gene Symbol: ARHGEF1
  Gene Name: Rho guanine nucleotide exchange factor (GEF) 1
  ENSP ID: ENSP00000473229
  MOD_RES (1)..(1): Any amino acid
XVQRRFVQEVVQSQQVAVGRQLEDFRSKRLMGMTPWEQELAQLEAWVGRDRASYEARERHVAERLLMHLEEMQTATLRCILGGWGPQA

SEQ ID NO: 73448 - protein, 1344 aa, Homo sapiens
  Payload ID: 14534
  Gene Symbol: ARHGEF10
  Gene Name: Rho guanine nucleotide exchange factor (GEF) 10
  Uniprot ID: O15013
  ENSP ID: ENSP00000340297
MDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 73449 - protein, 380 aa, Homo sapiens
  Payload ID: 14534
  Gene Symbol: ARHGEF10
  Gene Name: Rho guanine nucleotide exchange factor (GEF) 10
  ENSP ID: ENSP00000381568
MENPEEAIYDDVPRENSDSEPDEMIYDDVENGDEGGNSSLEYGWSSSEFESYEEQSDSECKNGIPRSFLRSNHKKQMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKVERGFLQLYSKIIFALC

SEQ ID NO: 73450 - protein, 1369 aa, Homo sapiens
  Payload ID: 14534
  Gene Symbol: ARHGEF10
  Gene Name: Rho guanine nucleotide exchange factor (GEF) 10
  Uniprot ID: O15013
  ENSP ID: ENSP00000381571
MRPPGFLSRAPSLNRAERGIWSCSMDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 73451 - protein, 988 aa, Homo sapiens
  Payload ID: 14534
  Gene Symbol: ARHGEF10
  Gene Name: Rho guanine nucleotide exchange factor (GEF) 10
  ENSP ID: ENSP00000427768
AKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 73452 - protein, 1306 aa, Homo sapiens
  Payload ID: 14534
  Gene Symbol: ARHGEF10
  Gene Name: Rho guanine nucleotide exchange factor (GEF) 10
  Uniprot ID: O15013
  ENSP ID: ENSP00000427909
MDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKQEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 73453 - protein, 1368 aa, Homo sapiens
  Payload ID: 14534
  Gene Symbol: ARHGEF10
  Gene Name: Rho guanine nucleotide exchange factor (GEF) 10
  Uniprot ID: O15013
  ENSP ID: ENSP00000431012
MRPPGFLSRAPSLNRAERGIWSCSMDQREPLPPAPAENEMKYDTNNNEEEEGEQFDFDSGDEIPEADRQAPSAPETGGAGASEAPAPTGGEDGAGAETTPVAEPTKLVLPMKVNPYSVIDITPFQEDQPPTPVPSAEEENVGLHVPCGYLVPVPCGYAVPSNLPLLLPAYSSPVIICATSLDEEAETPEVTEDRQPNSLSSEEPPTSEDQVGREDSALARWAADPANTAWMENPEEAIYDDVPRENSDSEPDEMIYDDVENGDEGGNSSLEYGWSSSEFESYEEQSDSECKNGIPRSFLRSNHKKQLSHDLTRLKEHYEKKMRDLMASTVGVVEIQQLRQKHELKMQKLVKAAKDGTKDGLERTRAAVKRGRSFIRTKSLIAQDHRSSLEEEQNLFIDVDCKHPEAILTPMPEGLSQQQVVRRYILGSVVDSEKNYVDALKRILEQYEKPLSEMEPKVLSERKLKTVFYRVKEILQCHSLFQIALASRVSEWDSVEMIGDVFVASFSKSMVLDAYSEYVNNFSTAVAVLKKTCATKPAFLEFLKEQEASPDRTTLYSLMMKPIQRFPQFILLLQDMLKNTSKGHPDRLPLQMALTELETLAEKLNERKRDADQRCEVKQIAKAINERYLNKLLSSGSRYLIRSDDMIETVYNDRGEIVKTKERRVFMLNDVLMCATVSSRPSHDSRVMSSQRYLLKWSVPLGHVDAIEYGSSAGTGEHSRHLAVHPPESLAVVANAKPNKVYMGPGQLYQDLQNLLHDLNVIGQITQLIGNLKGNYQNLNQSVAHDWTSGLQRLILKKEDEIRAADCCRIQLQLPGKQDKSGRPTFFTAVFNTFTPAIKESWVNSLQMAKLALEEENHMGWFCVEDDGNHIKKEKHPLLVGHMPVMVAKQQEFKIECAAYNPEPYLNNESQPDSFSTAHGFLWIGSCTHQMGQIAIVSFQNSTPKVIECFNVESRILCMLYVPVEEKRREPGAPPDPETPAVRASDVPTICVGTEEGSISIYKSSQGSKKVRLQHFFTPEKSTVMSLACTSQSLYAGLVNGAVASYARAPDGSWDSEPQKVIKLGVLPVRSLLMMEDTLWAASGGQVFIISVETHAVEGQLEAHQEEGMVISHMAVSGVGIWIAFTSGSTLRLFHTETLKHLQDINIATPVHNMLPGHQRLSVTSLLVCHGLLMVGTSLGVLVALPVPRLQGIPKVTGRGMVSYHAHNSPVKFIVLATALHEKDKDKSRDSLAPGPEPQDEDQKDALPSGGAGSSLSQGDPDAAIWLGDSLGSMTQKSDLSSSSGSLSLSHGSSSLEHRSEDSTIYDLLKDPVSLRSKARRAKKAKASSALVVCGGQGHRRVHRKARQPHQEELAPTVMVWQIPLLNI

SEQ ID NO: 73454 - protein, 380 aa, Homo sapiens; identical to SEQ ID NO: 73449
  Payload ID: 14534
  Gene Symbol: ARHGEF10
  Gene Name: Rho guanine nucleotide exchange factor (GEF) 10
  ENSP ID: ENSP00000477521

SEQ ID NO: 73455 - protein, 1344 aa, Homo sapiens; identical to SEQ ID NO: 73448
  Payload ID: 14534
  Gene Symbol: ARHGEF10
  Gene Name: Rho guanine nucleotide exchange factor (GEF) 10
  Uniprot ID: O15013
  ENSP ID: ENSP00000477988

SEQ ID NO: 73456 - protein, 1369 aa, Homo sapiens; identical to SEQ ID NO: 73450
  Payload ID: 14534
  Gene Symbol: ARHGEF10
  Gene Name: Rho guanine nucleotide exchange factor (GEF) 10
  Uniprot ID: O15013
  ENSP ID: ENSP00000481974

SEQ ID NO: 73457 - protein, 1306 aa, Homo sapiens; identical to SEQ ID NO: 73452
  Payload ID: 14534
  Gene Symbol: ARHGEF10
  Gene Name: Rho guanine nucleotide exchange factor (GEF) 10
  Uniprot ID: O15013
  ENSP ID: ENSP00000488343

SEQ ID NO: 73458 - protein, 988 aa, Homo sapiens; identical to SEQ ID NO: 73451
  Payload ID: 14534
  Gene Symbol: ARHGEF10
  Gene Name: Rho guanine nucleotide exchange factor (GEF) 10
  ENSP ID: ENSP00000488344

SEQ ID NO: 73459 - protein, 1368 aa, Homo sapiens; identical to SEQ ID NO: 73453
  Payload ID: 14534
  Gene Symbol: ARHGEF10
  Gene Name: Rho guanine nucleotide exchange factor (GEF) 10
  Uniprot ID: O15013
  ENSP ID: ENSP00000488463

SEQ ID NO: 73460 - protein, 611 aa, Homo sapiens
  Payload ID: 14535
  Gene Symbol: ARHGEF10L
  Gene Name: Rho guanine nucleotide exchange factor (GEF) 10-like
  Uniprot ID: Q9HCE6
  ENSP ID: ENSP00000167825
KPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPDRSLIKCSPRA

SEQ ID NO: 73461 - protein, 1279 aa, Homo sapiens
  Payload ID: 14535
  Gene Symbol: ARHGEF10L
  Gene Name: Rho guanine nucleotide exchange factor (GEF) 10-like
  Uniprot ID: Q9HCE6
  ENSP ID: ENSP00000355060
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 73462 - protein, 1052 aa, Homo sapiens
  Payload ID: 14535
  Gene Symbol: ARHGEF10L
  Gene Name: Rho guanine nucleotide exchange factor (GEF) 10-like
  ENSP ID: ENSP00000364557
MLPSSSWGKRKLRGRLGWVRSDARGVMWARQEGLHHPHPHAVIRCPSSSSSSVSCSGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 73463 - protein, 1240 aa, Homo sapiens
  Payload ID: 14535
  Gene Symbol: ARHGEF10L
  Gene Name: Rho guanine nucleotide exchange factor (GEF) 10-like
  Uniprot ID: Q9HCE6
  ENSP ID: ENSP00000364564
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 73464 - protein, 1522 aa, Homo sapiens
  Payload ID: 14536
  Gene Symbol: ARHGEF11
  Gene Name: Rho guanine nucleotide exchange factor (GEF) 11
  Uniprot ID: O15085
  ENSP ID: ENSP00000354644
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 73465 - protein, 1562 aa, Homo sapiens
  Payload ID: 14536
  Gene Symbol: ARHGEF11
  Gene Name: Rho guanine nucleotide exchange factor (GEF) 11
  Uniprot ID: O15085
  ENSP ID: ENSP00000357177
MSVRLPQSIDRLSSLSSLGDSAPERKSPSHHRQPSDASETTGLVQRCVIIQKDQHGFGFTVSGDRIVLVQSVRPGGAAMKAGVKEGDRIIKVNGTMVTNSSHLEVVKLIKSGAYVALTLLGSSPSSMGISGLQQDPSPAGAPRITSVIPSPPPPPPLPPPQRITGPKPLQDPEVQKHATQILRNMLRQEEKELQRICEVYSRNPASLLEEQIEGARRRVTQLQLKIQQETGGSVDILPLYGDTSQRPSEGRLSLDSQEGDSGLDSGTERFPSLSESLMNRNSVLSDPGLDSPRTSPVIMARVAQHHRRQGSDAAVPSTGDQGVDQSPKPLIIGPEEDYDPGYFNNESDIIFQDLEKLKSRPAHLGVFLRYIFSQADPSPLLFYLCAEVYQQASPKDSRSLGKDIWNIFLEKNAPLRVKIPEMLQAEIDSRLRNSEDARGVLCEAQEAAMPEIQEQIHDYRTKRTLGLGSLYGENDLLDLDGDPLRERQVAEKQLAALGDILSKYEEDRSAPMDFALNTYMSHAGIRLREARPSNTAEKAQSAPDKDKWLPFFPKTKKSSNSKKEKDALEDKKRNPILKYIGKPKSSSQSTFHIPLSPVEVKPGNVRNIIQHFENNQQYDAPEPGTQRLSTGSFPEDLLESDSSRSEIRLGRSESLKGREEMKRSRKAENVPRSRSDVDMDAAAEATRLHQSASSSTSSLSTRSLENPTPPFTPKMGRRSIESPSLGFCTDTLLPHLLEDDLGQLSDLEPEPDAQNWQHTVGKDVVAGLTQREIDRQEVINELFVTEASHLRTLRVLDLIFYQRMKKENLMPREELARLFPNLPELIEIHNSWCEAMKKLREEGPIIKEISDLMLARFDGPAREELQQVAAQFCSYQSIALELIKTKQRKESRFQLFMQEAESHPQCRRLQLRDLIISEMQRLTKYPLLLESIIKHTEGGTSEHEKLCRARDQCREILKYVNEAVKQTENRHRLEGYQKRLDATALERASNPLAAEFKSLDLTTRKMIHEGPLTWRISKDKTLDLHVLLLEDLLVLLQKQDEKLLLKCHSKTAVGSSDSKQTFSPVLKLNAVLIRSVATDKRAFFIICTSKLGPPQIYELVALTSSDKNTWMELLEEAVRNATRHPGAAPMPVHPPPPGPREPAQQGPTPSRVELDDSDVFHGEPEPEELPGGTGSQQRVQGKHQVLLEDPEQEGSAEEEELGVLPCPSTSLDGENRGIRTRNPIHLAFPGPLFMEGLADSALEDVENLRHLILWSLLPGHTMETQAAQEPEDDLTPTPSVISVTSHPWDPGSPGQAPPGGEGDNTQLAGLEGERPEQEDMGLCSLEHLPPRTRNSGIWESPELDRNLAEDASSTEAAGGYKVVRKAEVAGSKVVPALPESGQSEPGPPEVEGGTKATGNCFYVSMPSGPPDSSTDHSEAPMSPPQPDSLPAGQTEPQPQLQGGNDDPRRPSRSPPSLALRDVGMIFHTIEQLTLKLNRLKDMELAHRELLKSLGGESSGGTTPVGSFHTEAARWTDGSLSPPAKEPLASDSRNSHELGPCPEDGSDAPLEDSTADAAASPGP

SEQ ID NO: 73466 - protein, 1525 aa, Homo sapiens
  Payload ID: 14537
  Gene Symbol: ARHGEF12
  Gene Name: Rho guanine nucleotide exchange factor (GEF) 12
  Uniprot ID: Q9NZN5
  ENSP ID: ENSP00000349056
MSGTQSTITDRFPLKKPIRHGSILNRESPTDKKQKVERIASHDFDPTGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 73467 - protein, 1544 aa, Homo sapiens
  Payload ID: 14537
  Gene Symbol: ARHGEF12
  Gene Name: Rho guanine nucleotide exchange factor (GEF) 12
  Uniprot ID: Q9NZN5
  ENSP ID: ENSP00000380942
MSGTQSTITDRFPLKKPIRHGSILNRESPTDKKQKVERIASHDFDPTDSSSKKTKSSSEESRSEIYGLVQRCVIIQKDDNGFGLTVSGDNPVFVQSVKEDGAAMRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 73468 - protein, 1441 aa, Homo sapiens
  Payload ID: 14537
  Gene Symbol: ARHGEF12
  Gene Name: Rho guanine nucleotide exchange factor (GEF) 12
  ENSP ID: ENSP00000432984
MRAGVQTGDRIIKVNGTLVTHSNHLEVVKLIKSGSYVALTVQGRPPGSPQIPLADSEVEPSVIGHMSPIMTSPHSPGASGNMERITSPVLMGEENNVVHNQKVEILRKMLQKEQERLQLLQEDYNRTPAQRLLKEIQEAKKHIPQLQEQLSKATGSAQDGAVVTPSRPLGDTLTVSEAETDPGDVLGRTDCSSGDASRPSSDNADSPKSGPKERIYLEENPEKSETIQDTDTQSLVGSPSTRIAPHIIGAEDDDFGTEHEQINGQCSCFQSIELLKSRPAHLAVFLHHVVSQFDPATLLCYLYSDLYKHTNSKETRRIFLEFHQFFLDRSAHLKVSVPDEMSADLEKRRPELIPEDLHRHYIQTMQERVHPEVQRHLEDFRQKRSMGLTLAESELTKLDAERDKDRLTLEKERTCAEQIVAKIEEVLMTAQAVEEDKSSTMQYVILMYMKHLGVKVKEPRNLEHKRGRIGFLPKIKQSMKKDKEGEEKGKRRGFPSILGPPRRPSRHDNSAIGRAMELQKARHPKHLSTPSSVSPEPQDSAKLRQSGLANEGTDAGYLPANSMSSVASGASFSQEGGKENDTGSKQVGETSAPGDTLDGTPRTLNTVFDFPPPPLDQVQEEECEVERVTEHGTPKPFRKFDSVAFGESQSEDEQFENDLETDPPNWQQLVSREVLLGLKPCEIKRQEVINELFYTERAHVRTLKVLDQVFYQRVSREGILSPSELRKIFSNLEDILQLHIGLNEQMKAVRKRNETSVIDQIGEDLLTWFSGPGEEKLKHAAATFCSNQPFALEMIKSRQKKDSRFQTFVQDAESNPLCRRLQLKDIIPTQMQRLTKYPLLLDNIAKYTEWPTEREKVKKAADHCRQILNYVNQAVKEAENKQRLEDYQRRLDTSSLKLSEYPNVEELRNLDLTKRKMIHEGPLVWKVNRDKTIDLYTLLLEDILVLLQKQDDRLVLRCHSKILASTADSKHTFSPVIKLSTVLVRQVATDNKALFVISMSDNGAQIYELVAQTVSEKTVWQDLICRMAASVKEQSTKPIPLPQSTPGEGDNDEEDPSKLKEEQHGISVTGLQSPDRDLGLESTLISSKPQSHSLSTSGKSEVRDLFVAERQFAKEQHTDGTLKEVGEDYQIAIPDSHLPVSEERWALDALRNLGLLKQLLVQQLGLTEKSVQEDWQHFPRYRTASQGPQTDSVIQNSENIKAYHSGEGHMPFRTGTGDIATCYSPRTSTESFAPRDSVGLAPQDSQASNILVMDHMIMTPEMPTMEPEGGLDDSGEHFFDAREAHSDENPSEGDGAVNKEEKDVNLRISGNYLILDGYDPVQESSTDEEVASSLTLQPMTGIPAVESTHQQQHSPQNTHSDGAISPFTPEFLVQQRWGAMEYSCFEIQSPSSCADSQSQIMEYIHKIEADLEHLKKVEESYTILCQRLAGSALTDKHSDKS

SEQ ID NO: 73469 - protein, 841 aa, Homo sapiens
  Payload ID: 14538
  Gene Symbol: ARHGEF15
  Gene Name: Rho guanine nucleotide exchange factor (GEF) 15
  Uniprot ID: O94989
  ENSP ID: ENSP00000355026
MSAQSLPAATPPTQKPPRIIRPRPPSRSRAAQSPGPPHNGSSPQELPRNSNDAPTPMCTPIFWEPPAASLKPPALLPPSASRASLDSQTSPDSPSSTPTPSPVSRRSASPEPAPRSPVPPPKPSGSPCTPLLPMAGVLAQNGSASAPGTVRRLAGRFEGGAEGRAQDADAPEPGLQARADVNGEREAPLTGSGSQENGAPDAGLACPPCCPCVCHTTRPGLELRWVPVGGYEEVPRVPRRASPLRTSRSRPHPPSIGHPAVVLTSYRSTAERKLLPLLKPPKPTRVRQDATIFGDPPQPDLDLLSEDGIQTGDSPDEAPQNTPPATVEGREEEGLEVLKEQNWELPLQDEPLYQTYRAAVLSEELWGVGEDGSPSPANAGDAPTFPRPPGPRNTLWQELPAVQASGLLDTLSPQERRMQESLFEVVTSEASYLRSLRLLTDTFVLSQALRDTLTPRDHHTLFSNVQRVQGVSERFLATLLSRVRSSPHISDLCDVVHAHAVGPFSVYVDYVRNQQYQEETYSRLMDTNVRFSAELRRLQSLPKCERLPLPSFLLLPFQRITRLRMLLQNILRQTEEGSSRQENAQKALGAVSKIIERCSAEVGRMKQTEELIRLTQRLRFHKVKALPLVSWSRRLEFQGELTELGCRRGGVLFASRPRFTPLCLLLFSDLLLITQPKSGQRLQVLDYAHRSLVQAQQVPDPSGPPTFRLSLLSNHQGRPTHRLLQASSLSDMQRWLGAFPTPGPLPCSPDTIYEDCDCSQELCSESSAPAKTEGRSLESRAAPKHLHKTPEGWLKGLPGAFPAQLVCEVTGEHERRRHLRQNQRLLEAVGSSSGTPNAPPP

SEQ ID NO: 73470 - protein, 841 aa, Homo sapiens; identical to SEQ ID NO: 73469
  Payload ID: 14538
  Gene Symbol: ARHGEF15
  Gene Name: Rho guanine nucleotide exchange factor (GEF) 15
  Uniprot ID: O94989
  ENSP ID: ENSP00000412505

SEQ ID NO: 73471 - protein, 116 aa, Homo sapiens
  Payload ID: 14538
  Gene Symbol: ARHGEF15
  Gene Name: Rho guanine nucleotide exchange factor (GEF) 15
  ENSP ID: ENSP00000462796
MSAQSLPAATPPTQKPPRIIRPRPPSRSRAAQSPGPPHNGSSPQELPRNSNDAPTPMCTPIFWEPPAASLKPPALLPPSASRASLDSQTSPDSPSSTPTPSPVSRRSASPEPAPRS

SEQ ID NO: 73472 - protein, 91 aa, Homo sapiens
  Payload ID: 14538
  Gene Symbol: ARHGEF15
  Gene Name: Rho guanine nucleotide exchange factor (GEF) 15
  ENSP ID: ENSP00000463875
ASPLRTSRSRPHPPSIGHPAVVLTSYRSTAERKLLPLLKPPKPTRVRQDATIFGDPPQPDLDLLSEDGIQTGDSPDEAPQNTPPATVEGRY

SEQ ID NO: 73473 - protein, 207 aa, Homo sapiens
  Payload ID: 14538
  Gene Symbol: ARHGEF15
  Gene Name: Rho guanine nucleotide exchange factor (GEF) 15
  ENSP ID: ENSP00000464540
MSAQSLPAATPPTQKPPRIIRPRPPSRSRAAQSPGPPHNGSSPQELPRNSNDAPTPMCTPIFWEPPAASLKPPALLPPSASRASLDSQTSPDSPSSTPTPSPVSRRSASPEPAPRSPVPPPKPSGSPCTPLLPMAGVLAQNGSASAPGTVRRLAGRFEGGAEGRAQDADAPEPGLQARADVNGEREAPLTGSGSQENGAPDAGLACP

SEQ ID NO: 73474 - protein, 421 aa, Homo sapiens
  Payload ID: 14539
  Gene Symbol: ARHGEF16
  Gene Name: Rho guanine nucleotide exchange factor (GEF) 16
  Uniprot ID: Q5VV41
  ENSP ID: ENSP00000367622
MFEILTSEFSYQHSLSILVEEFLQSKELRATVTQMEHHHLFSNILDVLGASQRFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 73475 - protein, 421 aa, Homo sapiens; identical to SEQ ID NO: 73474
  Payload ID: 14539
  Gene Symbol: ARHGEF16
  Gene Name: Rho guanine nucleotide exchange factor (GEF) 16
  Uniprot ID: Q5VV41
  ENSP ID: ENSP00000367624

SEQ ID NO: 73476 - protein, 709 aa, Homo sapiens
  Payload ID: 14539
  Gene Symbol: ARHGEF16
  Gene Name: Rho guanine nucleotide exchange factor (GEF) 16
  Uniprot ID: Q5VV41
  ENSP ID: ENSP00000367629
MAQRHSDSSLEEKLLGHRFHSELRLDAGGNPASGLPMVRGSPRVRDDAAFQPQVPAPPQPRPPGHEEPWPIVLSTESPAALKLGTQQLIPKSLAVASKAKTPARHQSFGAAVLSREAARRDPKLLPAPSFSLDDMDVDKDPGGMLRRNLRNQSYRAAMKGLGKPGGQGDAIQLSPKLQALAEEPSQPHTRSPAKNKKTLGRKRGHKGSFKDDPQLYQEIQERGLNTSQESDDDILDESSSPEGTQKVDATIVVKSYRPAQVTWSQLPEVVELGILDQLSTEERKRQEAMFEILTSEFSYQHSLSILVEEFLQSKELRATVTQMEHHHLFSNILDVLGASQRFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERMEQMYTLHTQLDFSKVKSLPLISASRWLLKRGELFLVEETGLFRKIASRPTCYLFLFNDVLVVTKKKSEESYMVQDYAQMNHIQVEKIEPSELPLPGGGNRSSSVPHPFQVTLLRNSEGRQEQLLLSSDSASDRARWIVALTHSERQWQGLSSKGDLPQVEITKAFFAKQADEVTLQQADVVLVLQQEDGWLYGERLRDGETGWFPEDFARFITSRVAVEGNVRRMERLRVETDV

SEQ ID NO: 73477 - protein, 180 aa, Homo sapiens
  Payload ID: 14539
  Gene Symbol: ARHGEF16
  Gene Name: Rho guanine nucleotide exchange factor (GEF) 16
  ENSP ID: ENSP00000390853
MFASDLLRALDCCPGAGSSGLLPQLGPRQLLAFTVNCLGNHRYLGFFEDLEQRHKAQVLVEDISDILEEHAEKHFHPYIAYCSNEVYQQRTLQKLISSNAAFREALREIERRPACGGLPMLSFLILPMQRVTRLPLLMDTLCLKTQGHSERYKAASRALKAISKLVRQCNEGAHRMERME

SEQ ID NO: 73478 - protein, 146 aa, Homo sapiens
  Payload ID: 14539
  Gene Symbol: ARHGEF16
  Gene Name: Rho guanine nucleotide exchange factor (GEF) 16
  ENSP ID: ENSP00000411936
MFEILTSEFSYQHSLSILVEEFLQSKELRATVTQMEHHHLFSNILDVLGASQRFFEDLEQRHKAQVLVEDISDILEEHAEKHFHPYIAYCSNEVYQQRTLQKLISSNAAFREALREIERRPACGGLPMLSFLILPMQRVTRLPLLM

SEQ ID NO: 73479 - protein, 2063 aa, Homo sapiens
  Payload ID: 14540
  Gene Symbol: ARHGEF17
  Gene Name: Rho guanine nucleotide exchange factor (GEF) 17
  Uniprot ID: Q96PE2
  ENSP ID: ENSP00000263674
MADGAPRPQLYRSVSFKLLERWSGGPGLREEDTDTPGLRRRASCRPTTAARGQPSRRVSKLASGPLAAPAQPRPLRSLSPSVRQLSRRFDAPRLDDGSAGTRDGGVLPAAAEEAAEGPARGAWPSVTEMRKLFGGPGSRRPSADSESPGTPSPDGAAWEPPARESRQPPTPPPRTCFPLAGLRSARPLTGPETEGRLRRPQQQQERAQRPADGLHSWHIFSQPQAGARASCSSSSIAASYPVSRSRAASSSEEEEEGPPQLPGAQSPAYHGGHSSGSDDDRDGEGGHRWGGRPGLRPGSSLLDQDCRPDSDGLNLSSMNSAGVSGSPEPPTSPRAPREEGLREWGSGSPPCVPGPQEGLRPMSDSVGGAFRVAKVSFPSYLASPAGSRGSSRYSSTETLKDDDLWSSRGSGGWGVYRSPSFGAGEGLLRSQARTRAKGPGGTSRALRDGGFEPEKSRQRKSLSNPDIASETLTLLSFLRSDLSELRVRKPGGSSGDRGSNPLDGRDSPSAGGPVGQLEPIPIPAPASPGTRPTLKDLTATLRRAKSFTCSEKPMARRLPRTSALKSSSSELLLTGPGAEEDPLPLIVQDQYVQEARQVFEKIQRMGAQQDDGSDAPPGSPDWAGDVTRGQRSQEELSGPESSLTDEGIGADPEPPVAAFCGLGTTGMWRPLSSSSAQTNHHGPGTEDSLGGWALVSPETPPTPGALRRRRKVPPSGSGGSELSNGEAGEAYRSLSDPIPQRHRAATSEEPTGFSVDSNLLGSLSPKTGLPATSAMDEGLTSGHSDWSVGSEESKGYQEVIQSIVQGPGTLGRVVDDRIAGKAPKKKSLSDPSRRGELAGPGFEGPGGEPIREVEPMLPPSSSEPILVEQRAEPEEPGATRSRAQSERALPEALPPPATAHRNFHLDPKLADILSPRLIRRGSKKRPARSSHQELRRDEGSQDQTGSLSRARPSSRHVRHASVPATFMPIVVPEPPTSVGPPVAVPEPIGFPTRAHPTLQAPSLEDVTKQYMLNLHSGEVPAPVPVDMPCLPLAAPPSAEAKPPEAARPADEPTPASKCCSKPQVDMRKHVAMTLLDTEQSYVESLRTLMQGYMQPLKQPENSVLCDPSLVDEIFDQIPELLEHHEQFLEQVRHCMQTWHAQQKVGALLVQSFSKDVLVNIYSAYIDNFLNAKDAVRVAKEARPAFLKFLEQSMRENKEKQALSDLMIKPVQRIPRYELLVKDLLKHTPEDHPDHPLLLEAQRNIKQVAERINKGVRSAEEAERHARVLQEIEAHIEGMEDLQAPLRRFLRQEMVIEVKAIGGKKDRSLFLFTDLIVCTTLKRKSGSLRRSSMSLYTAASVIDTASKYKMLWKLPLEDADIIKGASQATNRENIQKAISRLDEDLTTLGQMSKLSESLGFPHQSLDDALRDLSAAMHRDLSEKQALCYALSFPPTKLELCATRPEGTDSYIFEFPHPDARLGFEQAFDEAKRKLASSKSCLDPEFLKAIPIMKTRSGMQFSCAAPTLNSCPEPSPEVWVCNSDGYVGQVCLLSLRAEPDVEACIAVCSARILCIGAVPGLQPRCHREPPPSLRSPPETAPEPAGPELDVEAAADEEAATLAEPGPQPCLHISIAGSGLEMTPGLGEGDPRPELVPFDSDSDDESSPSPSGTLQSQASRSTISSSFGNEETPSSKEATAETTSSEEEQEPGFLPLSGSFGPGGPCGTSPMDGRALRRSSHGSFTRGSLEDLLSVDPEAYQSSVWLGTEDGCVHVYQSSDSIRDRRNSMKLQHAASVTCILYLNNQVFVSLANGELVVYQREAGHFWDPQNFKSVTLGTQGSPITKMVSVGGRLWCGCQNRVLVLSPDTLQLEHMFYVGQDSSRCVACMVDSSLGVWVTLKGSAHVCLYHPDTFEQLAEVDVTPPVHRMLAGSDAIIRQHKAACLRITALLVCEELLWVGTSAGVVLTMPTSPGTVSCPRAPLSPTGLGQGHTGHVRFLAAVQLPDGFNLLCPTPPPPPDTGPEKLPSLEHRDSPWHRGPAPARPKMLVISGGDGYEDFRLSSGGGSSSETVGRDDSTNHLLLWRV

SEQ ID NO: 73480 - protein, 193 aa, Homo sapiens
  Payload ID: 14540
  Gene Symbol: ARHGEF17
  Gene Name: Rho guanine nucleotide exchange factor (GEF) 17
  ENSP ID: ENSP00000441135
  MOD_RES (1)..(1): Any amino acid
XSVGPPVAVPEPIGFPTRAHPTLQAPSLEDVTKQYMLNLHSGEVPAPVPVDMPCLPLAAPPSAEAKPPEAARPADEPTPASKCCSKPQVDMRKHVAMTLLDTEQSYVESLRTLMQVGLGAHSPENGLSEPRRLSDGCEQTPFMDKGLRPESRVPGIRRLSMKNPQHGHSREGGRLLPGKRECRGARPPQGRRP

SEQ ID NO: 73481 - protein, 802 aa, Homo sapiens
  Payload ID: 14541
  Gene Symbol: ARHGEF19
  Gene Name: Rho guanine nucleotide exchange factor (GEF) 19
  Uniprot ID: Q8IW93
  ENSP ID: ENSP00000270747
MDCGPPATLQPHLTGPPGTAHHPVAVCQQESLSFAELPALKPPSPVCLDLFPVAPEELRAPGSRWSLGTPAPLQGLLWPLSPGGSDTEITSGGMRPSRAGSWPHCPGAQPPALEGPWSPRHTQPQRRASHGSEKKSAWRKMRVYQREEVPGCPEAHAVFLEPGQVVQEQALSTEEPRVELSGSTRVSLEGPERRRFSASELMTRLHSSLRLGRNSAARALISGSGTGAAREGKASGMEARSVEMSGDRVSRPAPGDSREGDWSEPRLDTQEEPPLGSRSTNERRQSRFLLNSVLYQEYSDVASARELRRQQREEEGPGDEAEGAEEGPGPPRANLSPSSSFRAQRSARGSTFSLWQDIPDVRGSGVLATLSLRDCKLQEAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILPFQRITRLKMLVENILKRTAQGSEDEDMATKAFNALKELVQECNASVQSMKRTEELIHLSKKIHFEGKIFPLISQARWLVRHGELVELAPLPAAPPAKLKLSSKAVYLHLFNDCLLLSRRKELGKFAVFVHAKMAELQVRDLSLKLQGIPGHVFLLQLLHGQHMKHQFLLRARTESEKQRWISALCPSSPQEDKEVISEGEDCPQVQCVRTYKALHPDELTLEKTDILSVRTWTSDGWLEGVRLADGEKGWVPQAYVEEISSLSARLRNLRENKRVTSATSKLGEAPV

SEQ ID NO: 73482 - protein, 307 aa, Homo sapiens
  Payload ID: 14541
  Gene Symbol: ARHGEF19
  Gene Name: Rho guanine nucleotide exchange factor (GEF) 19
  ENSP ID: ENSP00000391145
  MOD_RES (1)..(1): Any amino acid
XRDRGQERLAQFPAAGRGSPGPPGARLGVGLEKGRGREVWRPGVWGCEARASEVNWSCPFDPVCALPQAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLLENPRFPGILARLEESPVCQRLPLTSFLILPFQRITRLKMLVENILKRTAQGSEDEDMATKAFNALKELVQECNASVQSMKRTEELIHLSKKIHFEGKIFPLISQARWLVRHGELVELAPLPAAPPAKLKLSSK

SEQ ID NO: 73483 - protein, 167 aa, Homo sapiens
  Payload ID: 14541
  Gene Symbol: ARHGEF19
  Gene Name: Rho guanine nucleotide exchange factor (GEF) 19
  ENSP ID: ENSP00000414370
ERLAQFPAAGRGSPGPPGARLGVGLEKGRGREVWRPGVWGCEARASEVNWSCPFDPVCALPQAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLL

SEQ ID NO: 73484 - protein, 580 aa, Homo sapiens
  Payload ID: 14542
  Gene Symbol: ARHGEF25
  Gene Name: Rho guanine nucleotide exchange factor (GEF) 25
  Uniprot ID: Q86VW2
  ENSP ID: ENSP00000286494
MRGGHKGGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 73485 - protein, 619 aa, Homo sapiens
  Payload ID: 14542
  Gene Symbol: ARHGEF25
  Gene Name: Rho guanine nucleotide exchange factor (GEF) 25
  Uniprot ID: Q86VW2
  ENSP ID: ENSP00000335560
MKPPDRPAPGRTDRILGVMGGMLRACALPGQEGPPRRSPLGLVGTEPESERTEGDHRRDREHEVLAGALQPESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 73486 - protein, 474 aa, Homo sapiens
  Payload ID: 14542
  Gene Symbol: ARHGEF25
  Gene Name: Rho guanine nucleotide exchange factor (GEF) 25
  Uniprot ID: Q86VW2
  ENSP ID: ENSP00000484303
MLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 73487 - protein, 871 aa, Homo sapiens
  Payload ID: 14543
  Gene Symbol: ARHGEF26
  Gene Name: Rho guanine nucleotide exchange factor (GEF) 26
  Uniprot ID: Q96DR7
  ENSP ID: ENSP00000348828
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSSGKPPADRTSLTQVEIVRSFTAKQPDELSLQVADVVLIYQRVSDGWYEGERLRDGERGWFPMECAKEITCQATIDKNVERMGRLLGLETNV

SEQ ID NO: 73488 - protein, 446 aa, Homo sapiens
  Payload ID: 14543
  Gene Symbol: ARHGEF26
  Gene Name: Rho guanine nucleotide exchange factor (GEF) 26
  Uniprot ID: Q96DR7
  ENSP ID: ENSP00000423295
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKVILIVGFMEMKDGRLRGGK

SEQ ID NO: 73489 - protein, 871 aa, Homo sapiens; identical to SEQ ID NO: 73487
  Payload ID: 14543
  Gene Symbol: ARHGEF26
  Gene Name: Rho guanine nucleotide exchange factor (GEF) 26
  Uniprot ID: Q96DR7
  ENSP ID: ENSP00000423418

SEQ ID NO: 73490 - protein, 791 aa, Homo sapiens
  Payload ID: 14543
  Gene Symbol: ARHGEF26
  Gene Name: Rho guanine nucleotide exchange factor (GEF) 26
  Uniprot ID: Q96DR7
  ENSP ID: ENSP00000424446
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSSGKPPADRTCG

SEQ ID NO: 73491 - protein, 871 aa, Homo sapiens; identical to SEQ ID NO: 73487
  Payload ID: 14543
  Gene Symbol: ARHGEF26
  Gene Name: Rho guanine nucleotide exchange factor (GEF) 26
  Uniprot ID: Q96DR7
  ENSP ID: ENSP00000481927

SEQ ID NO: 73492 - protein, 871 aa, Homo sapiens; identical to SEQ ID NO: 73487
  Payload ID: 14543
  Gene Symbol: ARHGEF26
  Gene Name: Rho guanine nucleotide exchange factor (GEF) 26
  Uniprot ID: Q96DR7
  ENSP ID: ENSP00000484367

SEQ ID NO: 73493 - protein, 446 aa, Homo sapiens; identical to SEQ ID NO: 73488
  Payload ID: 14543
  Gene Symbol: ARHGEF26
  Gene Name: Rho guanine nucleotide exchange factor (GEF) 26
  Uniprot ID: Q96DR7
  ENSP ID: ENSP00000486665

SEQ ID NO: 73494 - protein, 791 aa, Homo sapiens; identical to SEQ ID NO: 73490
  Payload ID: 14543
  Gene Symbol: ARHGEF26
  Gene Name: Rho guanine nucleotide exchange factor (GEF) 26
  Uniprot ID: Q96DR7
  ENSP ID: ENSP00000487265

SEQ ID NO: 73495 - protein, 1651 aa, Homo sapiens
  Payload ID: 14544
  Gene Symbol: ARHGEF28
  Gene Name: Rho guanine nucleotide exchange factor (GEF) 28
  Uniprot ID: Q8N1W1
  ENSP ID: ENSP00000296794
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGN

SEQ ID NO: 73496 - protein, 1392 aa, Homo sapiens
  Payload ID: 14544
  Gene Symbol: ARHGEF28
  Gene Name: Rho guanine nucleotide exchange factor (GEF) 28
  Uniprot ID: Q8N1W1
  ENSP ID: ENSP00000296799
MDSDSDSPFNYSWPSFPKMKIRRRTSKQDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNDLDTSHTESPTPHDSNSHRPQLQAFITEAKLNLPTRTMTRQDGETGDGAKENIVYL

SEQ ID NO: 73497 - protein, 1731 aa, Homo sapiens
  Payload ID: 14544
  Gene Symbol: ARHGEF28
  Gene Name: Rho guanine nucleotide exchange factor (GEF) 28
  Uniprot ID: Q8N1W1
  ENSP ID: ENSP00000411459
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGSSMTKCSCTLTSPPGLWTGTTSTLKDLDTSHTESPTPHDSNSHRPQLQAFITEAKLNLPTRTMTRQDGETGDGAKENIVYL

SEQ ID NO: 73498 - protein, 1705 aa, Homo sapiens
  Payload ID: 14544
  Gene Symbol: ARHGEF28
  Gene Name: Rho guanine nucleotide exchange factor (GEF) 28
  Uniprot ID: Q8N1W1
  ENSP ID: ENSP00000412175
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNDLDTSHTESPTPHDSNSHRPQLQAFITEAKLNLPTRTMTRQDGETGDGAKENIVYL

SEQ ID NO: 73499 - protein, 651 aa, Homo sapiens
  Payload ID: 14544
  Gene Symbol: ARHGEF28
  Gene Name: Rho guanine nucleotide exchange factor (GEF) 28
  ENSP ID: ENSP00000421081
MIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEALVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGSSMTKCSCTLTSPPGLWTGTTSTLKDLDTSHTESPTPHDSNSHRPQLQAFITEAKLNLPTRTMTRQDGETGDGAKENIVYL

SEQ ID NO: 73500 - protein, 83 aa, Homo sapiens
  Payload ID: 14544
  Gene Symbol: ARHGEF28
  Gene Name: Rho guanine nucleotide exchange factor (GEF) 28
  ENSP ID: ENSP00000421859
MELSCSEAPLYGQMMIYAKFDKNVYLPEDAEFYFTYDGSHQRHVMIAERIEDNVLQSSVPGHGLQETVTVSVCLCSEGYSPVT

SEQ ID NO: 73501 - protein, 1705 aa, Homo sapiens; identical to SEQ ID NO: 73498
  Payload ID: 14544
  Gene Symbol: ARHGEF28
  Gene Name: Rho guanine nucleotide exchange factor (GEF) 28
  Uniprot ID: Q8N1W1
  ENSP ID: ENSP00000441436

SEQ ID NO: 73502 - protein, 1731 aa, Homo sapiens; identical to SEQ ID NO: 73497
  Payload ID: 14544
  Gene Symbol: ARHGEF28
  Gene Name: Rho guanine nucleotide exchange factor (GEF) 28
  Uniprot ID: Q8N1W1
  ENSP ID: ENSP00000441913

SEQ ID NO: 73503 - protein, 526 aa, Homo sapiens
  Payload ID: 14545
  Gene Symbol: ARHGEF3
  Gene Name: Rho guanine nucleotide exchange factor (GEF) 3
  Uniprot ID: Q9NR81
  ENSP ID: ENSP00000296315
MVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 73504 - protein, 558 aa, Homo sapiens
  Payload ID: 14545
  Gene Symbol: ARHGEF3
  Gene Name: Rho guanine nucleotide exchange factor (GEF) 3
  Uniprot ID: Q9NR81
  ENSP ID: ENSP00000341071
MDSSTAMNQCSCRGMEENKERPKRQRQNNFPMFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 73505 - protein, 532 aa, Homo sapiens
  Payload ID: 14545
  Gene Symbol: ARHGEF3
  Gene Name: Rho guanine nucleotide exchange factor (GEF) 3
  Uniprot ID: Q9NR81
  ENSP ID: ENSP00000410922
MIEVCHHNWLLWLCPSKFGIFMCCLASTTGQMELRRTREPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 73506 - protein, 184 aa, Homo sapiens
  Payload ID: 14545
  Gene Symbol: ARHGEF3
  Gene Name: Rho guanine nucleotide exchange factor (GEF) 3
  ENSP ID: ENSP00000417087
MFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQ

SEQ ID NO: 73507 - protein, 236 aa, Homo sapiens
  Payload ID: 14545
  Gene Symbol: ARHGEF3
  Gene Name: Rho guanine nucleotide exchange factor (GEF) 3
  ENSP ID: ENSP00000417810
  MOD_RES (1)..(1): Any amino acid
XVESCPARSRLSVSVSPPPPGIVELGPPFAWEFCSRLGSAVTSQRAGPAAAMVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEAPLPQLL

SEQ ID NO: 73508 - protein, 416 aa, Homo sapiens
  Payload ID: 14545
  Gene Symbol: ARHGEF3
  Gene Name: Rho guanine nucleotide exchange factor (GEF) 3
  ENSP ID: ENSP00000417986
MVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERSMDSSRG

SEQ ID NO: 73509 - protein, 100 aa, Homo sapiens
  Payload ID: 14545
  Gene Symbol: ARHGEF3
  Gene Name: Rho guanine nucleotide exchange factor (GEF) 3
  ENSP ID: ENSP00000418469
MDSSTAMNQCSCRGMEENKERPKRQRQNNFPMFPSPKAWNFRGRKRKQSTQDEDAVSLCSLDISEPSNKRVKPLSRVTSLANLIPPVKATPLKRFSQTLQ

SEQ ID NO: 73510 - protein, 497 aa, Homo sapiens
  Payload ID: 14545
  Gene Symbol: ARHGEF3
  Gene Name: Rho guanine nucleotide exchange factor (GEF) 3
  ENSP ID: ENSP00000418826
MIEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 73511 - protein, 50 aa, Homo sapiens
  Payload ID: 14545
  Gene Symbol: ARHGEF3
  Gene Name: Rho guanine nucleotide exchange factor (GEF) 3
  ENSP ID: ENSP00000418984
MDSSTAMNQCSCRGMEENKERAVGGVSGTSAINGRNNWFFRLLRKSDLCG

SEQ ID NO: 73512 - protein, 196 aa, Homo sapiens
  Payload ID: 14545
  Gene Symbol: ARHGEF3
  Gene Name: Rho guanine nucleotide exchange factor (GEF) 3
  ENSP ID: ENSP00000420402
MFDRNIWPKRQRQNNFPMFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHE

SEQ ID NO: 73513 - protein, 532 aa, Homo sapiens
  Payload ID: 14545
  Gene Symbol: ARHGEF3
  Gene Name: Rho guanine nucleotide exchange factor (GEF) 3
  ENSP ID: ENSP00000420420
MRSERPMVWCCLFVRSQRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 73514 - protein, 70 aa, Homo sapiens
  Payload ID: 14545
  Gene Symbol: ARHGEF3
  Gene Name: Rho guanine nucleotide exchange factor (GEF) 3
  ENSP ID: ENSP00000420633
MFDRNICPVILHVKRTNSVLALRLVHSLNGSGKTTFPCFPLLKPGISEGSSRDHPRRKQLILTSLLQDLL

SEQ ID NO: 73515 - protein, 870 aa, Homo sapiens
  Payload ID: 14546
  Gene Symbol: ARHGEF33
  Gene Name: Rho guanine nucleotide exchange factor (GEF) 33
  Uniprot ID: A8MVX0
  ENSP ID: ENSP00000381780
MEKTKTKQGENEHMPVNNPSTQIYQLQALASELKTGFTEAMQELSRIQHGEYALEEKVKSCRCSMEEKVTEMKNSLNYFKEELSNAMSMIQAITSKQEEMQQKIEQLQQEKRRESRKVKAKKTQKEEHSSQAGPAQAQGSPFRSINIPEPVLPSEDFTNLLPSQAYEKAQESRSVHVGDSNVKGMMGPGVNPTTPEAEENLKSCLSADIQSKGHLPSGMWRQPKDGKEWGEEYVTKDHPDKLKEAGQGRHSSLENVLCETSLAAKRQTVALELLESERKYVINISLILKIKATFQGSDGKRNSKERSLFPGSLRYLVQQHLDLLHALQERVLKWPRQGVLGDLFLKLTNDENNFLDYYVAYLRDLPECISLVHVVVLKEGDEEIKSDIYTLFFHIVQRIPEYLIHLQNVLKFTEQEHPDYYLLLVCVQRLRVFISHYTLLFQCNEDLLIQKRKKLKKSSMAKLYKGLASQCANAGQDASPTAGPEAVRDTGIHSEELLQPYPSAPSSGPAITHLMPPVKKSQQQQSLMESMQPGKPSDWELEGRKHERPESLLAPTQFCAAEQDVKALAGPLQAIPEMDFESSPAEPLGNVERSLRAPAELLPDARGFVPAAYEEFEYGGEIFALPAPYDEEPFQAPALFENCSPASSESSLDICFLRPVSFAMEAERPEHPLQPLPKSATSPAGSSSAYKLEAAAQAHGKAKPLSRSLKEFPRAPPADGVAPRLYSTRSSSGGRAPIKAERAAQAHGPAAAAVAARGASRTFFPQQRSQSEKQTYLEVRREMHLEDTTRFCPKEERESEQTSFSDQNPRQDQKGGFRSSFRKLFKKKSSGSEYREKTNENPSMDPSPTKQDFFRNRLALANDLDQGTAV

SEQ ID NO: 73516 - protein, 870 aa, Homo sapiens; identical to SEQ ID NO: 73515
  Payload ID: 14546
  Gene Symbol: ARHGEF33
  Gene Name: Rho guanine nucleotide exchange factor (GEF) 33
  Uniprot ID: A8MVX0
  ENSP ID: ENSP00000387020

SEQ ID NO: 73517 - protein, 109 aa, Homo sapiens
  Payload ID: 14546
  Gene Symbol: ARHGEF33
  Gene Name: Rho guanine nucleotide exchange factor (GEF) 33
  ENSP ID: ENSP00000399688
  MOD_RES (1)..(1): Any amino acid
XGRAPIKAERAAQAHGPAAAAVAARGASRTFFPQQRSQSEKQTYLEEMHLEDTTRFCPKEERESEQTSFSDQNPRQDQKGGFRSSFRKLFKKKNGNATGEDFCGPWGWW

SEQ ID NO: 73518 - protein, 108 aa, Homo sapiens
  Payload ID: 14546
  Gene Symbol: ARHGEF33
  Gene Name: Rho guanine nucleotide exchange factor (GEF) 33
  ENSP ID: ENSP00000413620
GRAPIKAERAAQAHGPAAAAVAARGASRTFFPQQRSQSEKQTYLEEMHLEDTTRFCPKEERESEQTSFSDQNPRQDQKGGFRSSFRKLFKKKNGNATGEDFCGPWGWW

SEQ ID NO: 73519 - protein, 484 aa, Homo sapiens
  Payload ID: 14547
  Gene Symbol: ARHGEF35
  Gene Name: Rho guanine nucleotide exchange factor (GEF) 35
  Uniprot ID: A5YM69
  ENSP ID: ENSP00000367355
MEAEEAQHGASPPISAIEEFSIIPEAPMRSSQVSALGLEAQEDEDPSYKWREEHRLSATQQSELRDVCDYAIETMPSFPKEGSADVEPNQESLVAEACDTPEHWEAVPQSLAGRQARTLAPPELWACPIQSEHLDMAPFSSDLGSEEEEVEFWPGLTSLTLGSGQAEEEEETSSDNSGQTRYYSPCEEHPAETNQNEGAESGTIRQGEELPSEELQESQGLLHPQEVQVLEEQGQQEAGFRGEGTLREDVCADGLLGEEQMIEQVNDEKGEQKQKQEQVQDVMLGRQGERMGLTGEPEGLNDGEWEQEDMERKAQGQGGPEQGEERKRELQVPEENRADSQDEKSQTFLGKSEEVTGKQEDHGIKEKGVPVSGQEAKEPESWDGGRLGAVGRARSREEENEHHGPSMPALIAPEDSPHCDLFPGASYLVTQIPGTQTESRAEELSPAALSPLLEPIRCSHQPISLLGSFLTEESPDKEKLLSVL

SEQ ID NO: 73520 - protein, 675 aa, Homo sapiens
  Payload ID: 14548
  Gene Symbol: ARHGEF37
  Gene Name: Rho guanine nucleotide exchange factor (GEF) 37
  Uniprot ID: A1IGU5
  ENSP ID: ENSP00000328083
MAKHGADEPSSRSGSPDREGRASEDRSLLHQRLAVRELIDTEVSYLHMLQLCASDIRSRLQQLPQGDLDVLFSNIDDIIKVNSRFLHDLQETASKEEEQVQLVGNIFLEFQEELEQVYKVYCASYDQALLLVDTYRKEPELQRHIQGIVEAVVPQAGSSGLSFLLVIPLQRITRYPLLLQKILENTVPDASAYPVLQRAVSALQDVNTNINEYKMRKEVASKYTKVEQLTLRERLARINTHTLSKKTTRLSQLLKQEAGLIPRTEDKEFDDLEERFQWVSLCVTELKNNVAAYLDNLQAFLYFRPHEYNLDIPEGPAVQYCNLARDLHLEAFLKFKQRLEGLVWQPLCSLAKALLGPQNLIKKRLDKLLDFERVEEKLLEVGSVTYQEEAARHTYQALNSLLVAELPQFNQLVMQWLGQIMCTFVTLQRDLAKQVLQRAEGSMAQLPHHHVPEPAFRKLVEDALGRTSNQLRSFQETFEKVQPPPTTQPLLPGSERQVQALLSRYGPGKLYQVTSNISGTGTLDLTLPRGQIVAILQNKDTKGNSGRWLVDTGGHRGYVPAGKLQLYHVVPSAEELRRQAGLNKDPRCLTPEPSPALVPSIPTMNQVIAAYPFVARSSHEVSLQAGQPVTILEAQDKKGNPEWSLVEVNGQRGYVPSGFLARARSPVLWGWSLPS

SEQ ID NO: 73521 - protein, 103 aa, Homo sapiens
  Payload ID: 14548
  Gene Symbol: ARHGEF37
  Gene Name: Rho guanine nucleotide exchange factor (GEF) 37
  ENSP ID: ENSP00000425621
MAKHGADEPSSRSGSPDREGRASEDRSLLHQRLAVRELIDTEVSYLHMLQLCASDIRSRLQQLPQGDLDVLFSNIDDIIKVNSRFLHDLQETASKEEEQVQLV

SEQ ID NO: 73522 - protein, 219 aa, Homo sapiens
  Payload ID: 14549
  Gene Symbol: ARHGEF38
  Gene Name: Rho guanine nucleotide exchange factor (GEF) 38
  Uniprot ID: Q9NXL2
  ENSP ID: ENSP00000265154
MEPKEATGKENMVTKKKNLAFLRSRLYMLERRKTDTVVESSVSGDHSGTLRRSQSDRTEYNQKLQEKMTPQGECSVAETLTPEEEHHMKRMMAKREKIIKELIQTEKDYLNDLELCVREVVQPLRNKKTDRLDVDSLFSNIESVHQISAKLLSLLEEATTDVEPAMQVIGEVFLQIKGPLEDIYKIYCYHHDEAHSILESYEKEEELKEHLSHCIQSLK

SEQ ID NO: 73523 - protein, 777 aa, Homo sapiens
  Payload ID: 14549
  Gene Symbol: ARHGEF38
  Gene Name: Rho guanine nucleotide exchange factor (GEF) 38
  Uniprot ID: Q9NXL2
  ENSP ID: ENSP00000416125
MEPKEATGKENMVTKKKNLAFLRSRLYMLERRKTDTVVESSVSGDHSGTLRRSQSDRTEYNQKLQEKMTPQGECSVAETLTPEEEHHMKRMMAKREKIIKELIQTEKDYLNDLELCVREVVQPLRNKKTDRLDVDSLFSNIESVHQISAKLLSLLEEATTDVEPAMQVIGEVFLQIKGPLEDIYKIYCYHHDEAHSILESYEKEEELKEHLSHCIQSLKKIYMQEGKPNLLDMGSLMIKPIQRVMKYPLLLCELRNSTPPSHPDYRALDDAFAAVKDINVNINELKRRKDLVLKYKKNDEDESLKDKLSKLNIHSISKKSKRVTNHLKILTRGESQVKDNTFNREEKLFRALEKTVRLCVKNISLCLQHIQDAMPLALQSVMDLQEISYNKDDEMDYSETLSNALNSCHDFASHLQRLILTPLSALLSLFPGPHKLIQKRYDKLLDCNSYLQRSTGEESDLAKKEYEALNAQLVEELQAFNQAARKILLNCLCSFITLLRDLMLVAQQAYSTLVPMPLLVSSISEIQNQVLEEIQNLNCVKENSATFIERKLSFEKKKPVQILPEMPHQTDIHRSKLLSTYSAEELYQAKRKCNATQEYDINLLEGDLVAVIEQKDPLGSTSRWLVDTGNVKGYVYSSFLKPYNPAKMQKVDAENRFCDDDFENISLFVSSRPASDSVTGTSESSIGDSSSSLSGTCGKFETNGTDVDSFQEVDEQIFYAVHAFQARSDHELSLQEYQRVHILRFCDLSGNKEWWLAEAQGQKGYVPANYLGKMTYA

SEQ ID NO: 73524 - protein, 335 aa, Homo sapiens
  Payload ID: 14550
  Gene Symbol: ARHGEF39
  Gene Name: Rho guanine nucleotide exchange factor (GEF) 39
  Uniprot ID: Q8N4T4
  ENSP ID: ENSP00000367638
MELSCPGSRCPVQEQRARWERKRACTARELLETERRYQEQLGLVATYFLGILKAKGTLRPPERQALFGSWELIYGASQELLPYLEGGCWGQGLEGFCRHLELYNQFAANSERSQTTLQEQLKKNKGFRRFVRLQEGRPEFGGLQLQDLLPLPLQRLQQYENLVVALAENTGPNSPDHQQLTRAARLISETAQRVHTIGQKQKNDQHLRRVQALLSGRQAKGLTSGRWFLRQGWLLVVPPHGEPRPRMFFLFTDVLLMAKPRPPLHLLRSGTFACKALYPMAQCHLSRVFGHSGGPCGGLLSLSFPHEKLLLMSTDQEELSRWYHSLTWAISSQKN

SEQ ID NO: 73525 - protein, 186 aa, Homo sapiens
  Payload ID: 14550
  Gene Symbol: ARHGEF39
  Gene Name: Rho guanine nucleotide exchange factor (GEF) 39
  Uniprot ID: Q8N4T4
  ENSP ID: ENSP00000436519
MELSCPGSRCPVQEQRARWERKRACTARELLETERRYQEQLGLVATYFLGILKAKGTLRPPERQALFGSWELIYGASQELLPYLEGGCWGQGLEGFCRHLELYNQFAANSERSQTTLQEQLKKNKGFRRFVRLQEGRPEFGGLQLQDLLPLPLQRLQQYENLVVALAENTGPNSPDHQQLTPVLPS

SEQ ID NO: 73526 - protein, 299 aa, Homo sapiens
  Payload ID: 14550
  Gene Symbol: ARHGEF39
  Gene Name: Rho guanine nucleotide exchange factor (GEF) 39
  Uniprot ID: Q8N4T4
  ENSP ID: ENSP00000436756
MLGVCQTLKQYFLGILKAKGTLRPPERQALFGSWELIYGASQELLPYLEGGCWGQGLEGFCRHLELYNQFAANSERSQTTLQEQLKKNKGFRRFVRLQEGRPEFGGLQLQDLLPLPLQRLQQYENLVVALAENTGPNSPDHQQLTRAARLISETAQRVHTIGQKQKNDQHLRRVQALLSGRQAKGLTSGRWFLRQGWLLVVPPHGEPRPRMFFLFTDVLLMAKPRPPLHLLRSGTFACKALYPMAQCHLSRVFGHSGGPCGGLLSLSFPHEKLLLMSTDQEELSRWYHSLTWAISSQKN

SEQ ID NO: 73527 - protein, 690 aa, Homo sapiens
  Payload ID: 14551
  Gene Symbol: ARHGEF4
  Gene Name: Rho guanine nucleotide exchange factor (GEF) 4
  Uniprot ID: Q9NR80
  ENSP ID: ENSP00000316845
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 73528 - protein, 619 aa, Homo sapiens
  Payload ID: 14551
  Gene Symbol: ARHGEF4
  Gene Name: Rho guanine nucleotide exchange factor (GEF) 4
  Uniprot ID: Q9NR80
  ENSP ID: ENSP00000348017
MRPDGQQALDAVVRSFDCHSEAALRQRNDVIYCSLPRTAQGIVQREDQLEVLVSLREVWGRRRGRDGTCTGAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 73529 - protein, 720 aa, Homo sapiens [sequence omitted]

SEQ ID NO: 73530 - protein, 1014 aa, Homo sapiens
  Payload ID: 14551
  Gene Symbol: ARHGEF4
  Gene Name: Rho guanine nucleotide exchange factor (GEF) 4
  ENSP ID: ENSP00000386794
MRALVRAHSIAGFSPECPEDPVGQNVVKSGTHVKEGAKNERDPRIQNIPSPAPTQLSGPIPAFQSGAPHLQGPCKPGGFRLQRASQDTPSAGLLGENQLRQDSRSCLVASCLTSELVKLSAEEVPEPAECKSEQSPESRTQEPQGTQLAPRAADERETQKHLWGISVQAGNQTSNYTSKYVLSEESKSPTRAKFPRQPSSEGTQVWSGDLMGCLEVSDSSDAPETTQKSSAIDTSKAAEEAMVLDPNYREQALQGLSEFKAATVSHCGPGAEEGEQGPGGAGGRQLEPKAGGEASRGRGALIIVAVEQKGLQASRSNAGPVPETLPRDFPKERPESPLSTGETPCESPTRGKTPAGNECELPAAPIQGAGDGALQRVAQAAELGRVLVPQAASEETPSTEEPPGERLRGESRSSGSGERGPEEAPEGGAAAARGQRPRVPALEPPQPPRGLRKGAQEPGKRPTFSKVTSFRKGRPLATESPGGVPAPTTEGRRWGSSGPEGLPRENPPAAAGRDAPPLHHGDASAWPEFVPQAAGDRTAGPAGAGHTGTSGDLGSRGPSSESCNAKRLKTTEKKLRARLALAHKTFSNFIESIVLEKENTHERSPSSPKGEKEKSRLRQGSWRAFLKSKDAGSPKKPTLVSLPLGPEVLSPAETDSHCEERAEDKEGYVFSDHWAPPLASTPLSSSLVSPEHRRKSEPTIKCTATQEGGRYLPSGIFPEKSWLASPGSPRAQQAGIAHTLPSSSACCLAYENPGTPCRPTSPKPLSPRPSAQRMGLHYPGRGSAISMVSLGSYSYVDSSSGDPERPKIPKGQTSFLLSLQTLNQDEQKEESREGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTGELRASLFCYVLWILA

SEQ ID NO: 73531 - protein, 630 aa, Homo sapiens
  Payload ID: 14551
  Gene Symbol: ARHGEF4
  Gene Name: Rho guanine nucleotide exchange factor (GEF) 4
  ENSP ID: ENSP00000387285
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 73532 - protein, 372 aa, Homo sapiens
  Payload ID: 14551
  Gene Symbol: ARHGEF4
  Gene Name: Rho guanine nucleotide exchange factor (GEF) 4
  ENSP ID: ENSP00000389661
PLASTPLSSSLVSPEHRRKSEPTIKCTATQEGGRYLPSGIFPEKSWLASPGSPRAQQAGIAHTLPSSSACCLAYENPGTPCRPTSPKPLSPRPSAQRMGLHYPGRGSAISMVSLGSYSYVDSSSGDPERPKIPKGQTSFLLSLQTLNQDEQKEESREGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAVGRPCYLTRQKHPALPSNRPQQQVLVLAEPRRKPSTFWHSISRLAPFRK

SEQ ID NO: 73533 - protein, 192 aa, Homo sapiens
  Payload ID: 14551
  Gene Symbol: ARHGEF4
  Gene Name: Rho guanine nucleotide exchange factor (GEF) 4
  ENSP ID: ENSP00000398455
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAVGRPCYLTRQKHPALPSNRPQQQVLVLAEPRRKPSTFWHSISRLAPFRK

SEQ ID NO: 73534 - protein, 670 aa, Homo sapiens
  Payload ID: 14551
  Gene Symbol: ARHGEF4
  Gene Name: Rho guanine nucleotide exchange factor (GEF) 4
  Uniprot ID: Q9NR80
  ENSP ID: ENSP00000432267
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 73535 - protein, 287 aa, Homo sapiens
  Payload ID: 14551
  Gene Symbol: ARHGEF4
  Gene Name: Rho guanine nucleotide exchange factor (GEF) 4
  ENSP ID: ENSP00000432301
  MOD_RES (1)..(1): Any amino acid
XACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 73536 - protein, 630 aa, Homo sapiens; identical to SEQ ID NO: 73531
  Payload ID: 14551
  Gene Symbol: ARHGEF4
  Gene Name: Rho guanine nucleotide exchange factor (GEF) 4
  ENSP ID: ENSP00000483548

SEQ ID NO: 73537 - protein, 1519 aa, Homo sapiens
  Payload ID: 14552
  Gene Symbol: ARHGEF40
  Gene Name: Rho guanine nucleotide exchange factor (GEF) 40
  Uniprot ID: Q8TER5
  ENSP ID: ENSP00000298694
MEPEPVEDCVQSTLAALYPPFEATAPTLLGQVFQVVERTYREDALRYTLDFLVPAKHLLAKVQQEACAQYSGFLFFHEGWPLCLHEQVVVQLAALPWQLLRPGDFYLQVVPSAAQAPRLALKCLAPGGGRVQEVPVPNEACAYLFTPEWLQGINKDRPTGRLSTCLLSAPSGIQRLPWAELICPRFVHKEGLMVGHQPSTLPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQDSGDPPLVQRLLILIHDDLPTELCGFQGAEVLSENDLKRVAKPEELQWELGGHRDPSPSHWVEIHQEVVRLCRLCQGVLGSVRQAIEELEGAAEPEEEEAVGMPKPLQKVLADPRLTALQRDGGAILMRLRSTPSSKLEGQGPATLYQEVDEAIHQLVRLSNLHVQQQEQRQCLRRLQQVLQWLSGPGEEQLASFAMPGDTLSALQETELRFRAFSAEVQERLAQAREALALEENATSQKVLDIFEQRLEQVESGLHRALRLQRFFQQAHEWVDEGFARLAGAGPGREAVLAALALRRAPEPSAGTFQEMRALALDLGSPAALREWGRCQARCQELERRIQQHVGEEASPRGYRRRRADGASSGGAQWGPRSPSPSLSSLLLPSSPGPRPAPSHCSLAPCGEDYEEEGPELAPEAEGRPPRAVLIRGLEVTSTEVVDRTCSPREHVLLGRARGPDGPWGVGTPRMERKRSISAQQRLVSELIACEQDYVATLSEPVPPPGPELTPELRGTWAAALSARERLRSFHRTHFLRELQGCATHPLRIGACFLRHGDQFSLYAQYVKHRHKLENGLAALSPLSKGSMEAGPYLPRALQQPLEQLTRYGRLLEELLREAGPELSSECRALGAAVQLLREQEARGRDLLAVEAVRGCEIDLKEQGQLLHRDPFTVICGRKKCLRHVFLFEHLLLFSKLKGPEGGSEMFVYKQAFKTADMGLTENIGDSGLCFELWFRRRRAREAYTLQATSPEIKLKWTSSIAQLLWRQAAHNKELRVQQMVSMGIGNKPFLDIKALGERTLSALLTGRAARTRASVAVSSFEHAGPSLPGLSPGACSLPARVEEEAWDLDVKQISLAPETLDSSGDVSPGPRNSPSLQPPHPGSSTPTLASRGILGLSRQSHARALSDPTTPL

SEQ ID NO: 73538 - protein, 557 aa, Homo sapiens
  Payload ID: 14552
  Gene Symbol: ARHGEF40
  Gene Name: Rho guanine nucleotide exchange factor (GEF) 40
  ENSP ID: ENSP00000451335
MEPEPVEDCVQSTLAALYPPFEATAPTLLGQVFQVVERTYREDALRYTLDFLVPAKHLLAKVQQEACAQYSGFLFFHEGWPLCLHEQVVVQLAALPWQLLRPGDFYLQVVPSAAQAPRLALKCLAPGGGRVQEVPVPNEACAYLFTPEWLQGINKDRPTGRLSTCLLSAPSGIQRLPWAELICPRFVHKEGLMVGHQPSTLPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGQWASVGEGKQDWEREAI

SEQ ID NO: 73539 - protein, 502 aa, Homo sapiens
  Payload ID: 14552
  Gene Symbol: ARHGEF40
  Gene Name: Rho guanine nucleotide exchange factor (GEF) 40
  ENSP ID: ENSP00000451655
MEPEPVEDCVQSTLAALYPPFEATAPTLLGQVFQVVERTYREDALRYTLDFLVPAKHLLAKVQQEACAQYSGFLFFHEGWPLCLHEQVVVQLAALPWQLLRPGDFYLQVVPSAAQAPRLALKCLAPGGGRVQEVPVPNEACAYLFTPEWLQGINKDRPTGRLSTCLLSAPSGIQRLPWAELICPRFVHKEGLMVGHQPSTLPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPRHTGPEGPLSDTPTPPLETVQEGKGDNIPEEALAVSVSDHPDVAWDLMASGFLILTAWPFCVFRRGGPEWASSADHYPTVPS

SEQ ID NO: 73540 - protein, 620 aa, Homo sapiens
  Payload ID: 14552
  Gene Symbol: ARHGEF40
  Gene Name: Rho guanine nucleotide exchange factor (GEF) 40
  ENSP ID: ENSP00000452283
MEPEPVEDCVQSTLAALYPPFEATAPTLLGQVFQVVERTYREDALRYTLDFLVPAKHLLAKVQQEACAQYSGFLFFHEGWPLCLHEQVVVQLAALPWQLLRPGDFYLQVVPSAAQAPRLALKCLAPGGGRVQEVPVPNEACAYLFTPEWLQGINKDRPTGRLSTCLLSAPSGIQRLPWAELICPRFVHKEGLMVGHQPSTLPPELPSGPPGLPSPPLPEEALGTRSPGDGHNAPVEGPEGEYVELLEVTLPVRGSPTDAEGSPGLSRVRTVPTRKGAGGKGRHRRHRAWMHQKGLGPRGQDGARPPGEGSSTGASPESPPGAEAVPEAAVLEVSEPPAEAVGEASGSCPLRPGELRGGGGGGQGAEGPPGTPRRTGKGNRRKKRAAGRGALSRGGDSAPLSPGDKEDASHQEALGNLPSPSEHKLPECHLVKEEYEGSGKPESEPKELKTAGEKEPQLSEACGPTEEGAGERELEGPGLLCMAGHTGPEGPLSDTPTPPLETVQEGKGDNIPEEALAVSVSDHPDVAWDLMASGFLILTGGVDQSGRALLTITPPCPPEEPPPSRDTLNTTLHYLHSLLRPDLQTLGLSVLLDLRQAPPLPPALIPALSQLQFRVILFCP

SEQ ID NO: 73541 - protein, 1597 aa, Homo sapiens
  Payload ID: 14553
  Gene Symbol: ARHGEF5
  Gene Name: Rho guanine nucleotide exchange factor (GEF) 5
  Uniprot ID: Q12774
  ENSP ID: ENSP00000056217
MEAEEAQRGASPPISAIEEFSIIPEAPMRSSQVSALGLEAQEDEDPSYKWREEHRLSATQQSELRDVCDYAIETMPSFPKEGSADVEPNQESLVAEACDTPEHWEAVPQSLAGRQARTLAPPELWACPIQSEHLDMAPFSSDLGSEEEEVEFWPGLTSLTLGSGQAEEEEETSSDNSGQTRYYSPCEEHPAETNQNEGSESGTIRQGEELPPEELQESQGLLHPQEVQVLEEQGQQEAGFRGEGTLREDVCADGLLGEEQMIEQVNDEKGEQKQKQEQVQDVMLGRQGERMGLTGEPEGLNDGEWEQEDMERKAQGQGGPEQGEERKRELQVPEENRADSQDEKSQTFLGKSEEVTGKQEDHGIKEKGVPVSGQEAKEPESWDGGRLGAVGRARSREEENEHHGPSMPALIAPEDSPHCDLFPGASYLMTQIPGTQTESRAEELSPAALSPSLEPIRCSHQPISLLGSFLTEESPDKEIDQNSQQEESRLRKGTVSSQGTEVVFASASVTPPRTPDSAPPSPAEAYPITPASVSARPPVAFPRRETSCAARAPETASAPLSMDDPSPCGTSEMCPAALYGFPSTGTSPPRPPANSTGTVQHLRSDSFPGSHRTEQTPDLVGMLLSYSHSELPQRPPKPAIYSSVTPRRDRRSGRDYSTVSASPTALSTLKQDSQESISNLERPSSPPSIQPWVSPHNPAFATESPAYGSSPSFVSMEDVRIHEPLPPPPPQRRDTHPSVVETDGHARVVVPTLKQHSHPPPLALGSGLHAPHKGPLPQASDPAVARQHRPLPSTPDSSHHAQATPRWRYNKPLPPTPDLPQPHLPPISAPGSSRIYRPLPPLPIIDPPTEPPPLPPKSRGRSRSTRGGHMNSGGHAKTRPACQDWTVPLPASAGRTSWPPATARSTESFTSTSRSKSEVSPGMAFSNMTNFLCPSSPTTPWTPELQGPTSKDEAGVSEHPEAPAREPLRRTTPQQGASGPGRSPVGQARQPEKPSHLHLEKASSWPHRRDSGRPPGDSSGQAVAPSEGANKHKGWSRQGLRRPSILPEGSSDSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQSEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 73542 - protein, 181 aa, Homo sapiens
  Payload ID: 14553
  Gene Symbol: ARHGEF5
  Gene Name: Rho guanine nucleotide exchange factor (GEF) 5
  ENSP ID: ENSP00000417979
MEAEEAQRGASPPISAIEEFSIIPEAPMRSSQVSALGLEAQEDEDPSYKWREEHRLSATQQNSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHE

SEQ ID NO: 73543 - protein, 519 aa, Homo sapiens
  Payload ID: 14553
  Gene Symbol: ARHGEF5
  Gene Name: Rho guanine nucleotide exchange factor (GEF) 5
  Uniprot ID: Q12774
  ENSP ID: ENSP00000418227
MGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPREGSRFLVFDHAPFSSIRGEKCEMKLHGPHKNLFRLFLRQNTQGAQAEFLFRTETQSEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 73544 - protein, 797 aa, Homo sapiens
  Payload ID: 14553
  Gene Symbol: ARHGEF5
  Gene Name: Rho guanine nucleotide exchange factor (GEF) 5
  ENSP ID: ENSP00000418745
  MOD_RES (1)..(1): Any amino acid
XVVVPTLKQHSHPPPLALGSGLHAPHKGPLPQASDPAVARQHRPLPSTPDSSHHAQATPRWRYNKPLPPTPDLPQPHLPPISAPGSSRIYRPLPPLPIIDPPTEPPPLPPKSRGRSRSTRGGHMNSGGHAKTRPACQDWTVPLPASAGRTSWPPATARSTESFTSTSRSKSEVSPGMAFSNMTNFLCPSSPTTPWTPELQGPTSKDEAGVSEHPEAPAREPLRRTTPQQGASGPGRSPVGQARQPEKPSHLHLEKASSWPHRRDSGRPPGDSSGQAVAPSEGANKHKGWSRQGLRRPSILPEGSSDSRGPAVEKHPGPSDTVVFREKKPKEVMGGFSRRCSKLINSSQLLYQEYSDVVLNKEIQSQQRLESLSETPGPSSPRQPRKALVSSESYLQRLSMASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPRESEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 73545 - protein, 705 aa, Homo sapiens
  Payload ID: 14554
  Gene Symbol: ARHGEF7
  Gene Name: Rho guanine nucleotide exchange factor (GEF) 7
  ENSP ID: ENSP00000218789
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 73546 - protein, 782 aa, Homo sapiens
  Payload ID: 14554
  Gene Symbol: ARHGEF7
  Gene Name: Rho guanine nucleotide exchange factor (GEF) 7
  Uniprot ID: Q14155
  ENSP ID: ENSP00000325994
MNSAEQTVTWLITLGVLESPKKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 73547 - protein, 625 aa, Homo sapiens
  Payload ID: 14554
  Gene Symbol: ARHGEF7
  Gene Name: Rho guanine nucleotide exchange factor (GEF) 7
  Uniprot ID: Q14155
  ENSP ID: ENSP00000364875
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 73548 - protein, 646 aa, Homo sapiens
  Payload ID: 14554
  Gene Symbol: ARHGEF7
  Gene Name: Rho guanine nucleotide exchange factor (GEF) 7
  Uniprot ID: Q14155
  ENSP ID: ENSP00000364888
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 73549 - protein, 753 aa, Homo sapiens
  Payload ID: 14554
  Gene Symbol: ARHGEF7
  Gene Name: Rho guanine nucleotide exchange factor (GEF) 7
  Uniprot ID: Q14155
  ENSP ID: ENSP00000364891
MNSAEQTVTWLITLGVLESPKKTISDPEGFLQASLKDGVVLCRLLERLLPGTIEKTFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 73550 - protein, 803 aa, Homo sapiens
  Payload ID: 14554
  Gene Symbol: ARHGEF7
  Gene Name: Rho guanine nucleotide exchange factor (GEF) 7
  Uniprot ID: Q14155
  ENSP ID: ENSP00000364893
MNSAEQTVTWLITLGVLESPKKTISDPEGFLQASLKDGVVLCRLLERLLPGTIEKVYPEPRSESECLSNIREFLRGCGASLRLELLFPPSQPPQHLVTTILLSASTFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 73551 - protein, 143 aa, Homo sapiens
  Payload ID: 14554
  Gene Symbol: ARHGEF7
  Gene Name: Rho guanine nucleotide exchange factor (GEF) 7
  ENSP ID: ENSP00000389890
MKTFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASGK

SEQ ID NO: 73552 - protein, 646 aa, Homo sapiens; identical to SEQ ID NO: 73548
  Payload ID: 14554
  Gene Symbol: ARHGEF7
  Gene Name: Rho guanine nucleotide exchange factor (GEF) 7
  Uniprot ID: Q14155
  ENSP ID: ENSP00000397068

SEQ ID NO: 73553 - protein, 66 aa, Homo sapiens
  Payload ID: 14554
  Gene Symbol: ARHGEF7
  Gene Name: Rho guanine nucleotide exchange factor (GEF) 7
  ENSP ID: ENSP00000406732
MTDNSNNQLVVRAKFNFQQTNEDELSFSKGDVIHVTRVEEGGWWEGTLNGRTGWFPSNYVREVKAS

SEQ ID NO: 73554 - protein, 547 aa, Homo sapiens
  Payload ID: 14554
  Gene Symbol: ARHGEF7
  Gene Name: Rho guanine nucleotide exchange factor (GEF) 7
  ENSP ID: ENSP00000417596
MGSCSSQSVQKTRRGRKVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 73555 - protein, 39 aa, Homo sapiens
  Payload ID: 14554
  Gene Symbol: ARHGEF7
  Gene Name: Rho guanine nucleotide exchange factor (GEF) 7
  ENSP ID: ENSP00000418043
MTDNSNNQLVVRAKFNFQQTNEDELSFSKGDVIHVTRVE

SEQ ID NO: 73556 - protein, 447 aa, Homo sapiens
  Payload ID: 14554
  Gene Symbol: ARHGEF7
  Gene Name: Rho guanine nucleotide exchange factor (GEF) 7
  ENSP ID: ENSP00000418067
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPH

SEQ ID NO: 73557 - protein, 151 aa, Homo sapiens
  Payload ID: 14554
  Gene Symbol: ARHGEF7
  Gene Name: Rho guanine nucleotide exchange factor (GEF) 7
  ENSP ID: ENSP00000418235
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVPVLSRGAESSAHEGGGTPRDCMEVEPGSPGSEVLPAGLKGMPASRHIWEPECAVV

SEQ ID NO: 73558 - protein, 61 aa, Homo sapiens
  Payload ID: 14554
  Gene Symbol: ARHGEF7
  Gene Name: Rho guanine nucleotide exchange factor (GEF) 7
  ENSP ID: ENSP00000420592
MTDNSNNQLVVRAKFNFQQTNEDELSFSKGDVIHVTRVEEGGWWEGTLNGRTGWFPSNYVR

SEQ ID NO: 73559 - protein, 130 aa, Homo sapiens
  Payload ID: 14554
  Gene Symbol: ARHGEF7
  Gene Name: Rho guanine nucleotide exchange factor (GEF) 7
  ENSP ID: ENSP00000445384
  MOD_RES (1)..(1): Any amino acid
XVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTVRTWCFSSFQTPGVASRG

SEQ ID NO: 73560 - protein, 1015 aa, Homo sapiens
  Payload ID: 14555
  Gene Symbol: ARHGEF18
  Gene Name: Rho/Rac guanine nucleotide exchange factor (GEF) 18
  Uniprot ID: Q6ZSZ5
  ENSP ID: ENSP00000319200
MTVSQKGGPQPTPSPAGPGTQLGPITGEMDEADSAFLKFKQTADDSLSLTSPNTESIFVEDPYTASLRSEIESDGHEFEAESWSLAVDAAYAKKQKREVVKRQDVLYELMQTEVHHVRTLKIMLKVYSRALQEELQFSSKAIGRLFPCADDLLETHSHFLARLKERRQESLEEGSDRNYVIQKIGDLLVQQFSGENGERMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRGLFRGGDPSETLQGELILKSAMSEIEGIQSLICRQLGSANGQAEDGGSSTGPPRRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQAVIAHQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPATPLSAKEDASKEDVIFF

SEQ ID NO: 73561 - protein, 1173 aa, Homo sapiens
  Payload ID: 14555
  Gene Symbol: ARHGEF18
  Gene Name: Rho/Rac guanine nucleotide exchange factor (GEF) 18
  Uniprot ID: Q6ZSZ5
  ENSP ID: ENSP00000352995
MVTVGTNILPSRPAASANTAREDAALFSRRIPPRHKNGAAQPGAAPGPGAPGANMGNAHSKSGDRHSALPGRPELSFYGSFPRKWSENVFLDNELLTSKILSVLRPQSERGFRAGDLRYPTHFLSTNSVLASVTASLKEHPRGTLLSDGSPALSRNVGMTVSQKGGPQPTPSPAGPGTQLGPITGEMDEADSAFLKFKQTADDSLSLTSPNTESIFVEDPYTASLRSEIESDGHEFEAESWSLAVDAAYAKKQKREVVKRQDVLYELMQTEVHHVRTLKIMLKVYSRALQEELQFSSKAIGRLFPCADDLLETHSHFLARLKERRQESLEEGSDRNYVIQKIGDLLVQQFSGENGERMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRGLFRGGDPSETLQGELILKSAMSEIEGIQSLICRQLGSANGQAEDGGSSTGPPRRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQAVIAHQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPATPLSAKEDASKEDVIFF

SEQ ID NO: 73562 - protein, 812 aa, Homo sapiens
  Payload ID: 14555
  Gene Symbol: ARHGEF18
  Gene Name: Rho/Rac guanine nucleotide exchange factor (GEF) 18
  ENSP ID: ENSP00000470729
  MOD_RES (1)..(1): Any amino acid
XRMKEKYGVFCSGHNEAVSHYKLLLQQNKKFQNLIKKIGNFSIVRRLGVQECILLVTQRITKYPVLVERIIQNTEAGTEDYEDLTQALNLIKDIISQVDAKVSECEKGQRLREIAGKMDLKSSSKLKNGLTFRKEDMLQRQLHLEGMLCWKTTSGRLKDILAILLTDVLLLLQEKDQKYVFASVDSKPPVISLQKLIVREVANEEKAMFLISASLQGPEMYEIYTSSKEDRNAWMAHIQRAVESCPDEEEGPFSLPEEERKVVEARATRLRDFQERLSMKDQLIAQSLLEKQQIYLEMAEMGGLEDLPQPRGLFRGGDPSETLQGELILKSAMSEIEGIQSLICRQLGSANGQAEDGGSSTGPPRRAETFAGYDCTNSPTKNGSFKKKVSSTDPRPRDWRGPPNSPDLKLSDSDIPGSSEESPQVVEAPGTESDPRLPTVLESELVQRIQTLSQLLLNLQDSYVETQRAAIQEREKQFRLQSTRGNLLLEQERQRNFEKQREERAALEKLQSQLRHEQQRWERERQWQHQELERAGARLQEREGEARQLRERLEQERAELERQRQAYQHDLERLREAQRAVERERERLELLRRLKKQNTAPGALPPDTLAEAQPPSHPPSFNGEGLEGPRVSMLPSGVGPEYAERPEVARRDSAPTENRLAKSDVPIQLLSATNQFQRQAAVQQQIPTKLAASTKGGKDKGGKSRGSQRWESSASFDLKQQLLLNKLMGKDESTSRNRRSLSPILPGRHSPAPPPDPGFPAPSPPPADSPSEGFSLKAGGTALLPGPPAPSPLPATPLSAKEDASKEDVIFF

SEQ ID NO: 73563 - protein, 86 aa, Homo sapiens
  Payload ID: 14555
  Gene Symbol: ARHGEF18
  Gene Name: Rho/Rac guanine nucleotide exchange factor (GEF) 18
  ENSP ID: ENSP00000471597
MTVSQKGGPQPTPSPAGPGTQLGPITGEMDEADSAFLKFKQTADDSLSLTSPNTESIFVEDPYTASLRSEIESDGHEFEAESWSLA

SEQ ID NO: 73564 - protein, 985 aa, Homo sapiens
  Payload ID: 14556
  Gene Symbol: ARHGEF2
  Gene Name: Rho/Rac guanine nucleotide exchange factor (GEF) 2
  Uniprot ID: Q92974
  ENSP ID: ENSP00000314787
MSRIESLTRARIDRSRELASKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 73565 - protein, 958 aa, Homo sapiens
  Payload ID: 14556
  Gene Symbol: ARHGEF2
  Gene Name: Rho/Rac guanine nucleotide exchange factor (GEF) 2
  Uniprot ID: Q92974
  ENSP ID: ENSP00000315325
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 73566 - protein, 986 aa, Homo sapiens
  Payload ID: 14556
  Gene Symbol: ARHGEF2
  Gene Name: Rho/Rac guanine nucleotide exchange factor (GEF) 2
  Uniprot ID: Q92974
  ENSP ID: ENSP00000354837
MSRIESLTRARIDRSRELASKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 73567 - protein, 264 aa, Homo sapiens [sequence omitted]

SEQ ID NO: 73568 - protein, 7 aa, Homo sapiens
  Payload ID: 14556
  Gene Symbol: ARHGEF2
  Gene Name: Rho/Rac guanine nucleotide exchange factor (GEF) 2
  ENSP ID: ENSP00000476518
MLSKSVP

SEQ ID NO: 73569 - protein, 83 aa, Homo sapiens
  Payload ID: 14556
  Gene Symbol: ARHGEF2
  Gene Name: Rho/Rac guanine nucleotide exchange factor (GEF) 2
  ENSP ID: ENSP00000476532
MLSKSVPVSGINCLLDRSDTDGNVSQSSAIDLRKRCSQLEGHSGTRVGSSLRQTFSFLSGMTGKAKTREKEKMKEAKDARYTN

SEQ ID NO: 73570 - protein, 263 aa, Homo sapiens
  Payload ID: 14556
  Gene Symbol: ARHGEF2
  Gene Name: Rho/Rac guanine nucleotide exchange factor (GEF) 2
  ENSP ID: ENSP00000476689
  MOD_RES (1)..(1): Any amino acid
XQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRGETLAETWTRDFTRMQDIPEETESRDGEAVASES

SEQ ID NO: 73571 - protein, 178 aa, Homo sapiens
  Payload ID: 14556
  Gene Symbol: ARHGEF2
  Gene Name: Rho/Rac guanine nucleotide exchange factor (GEF) 2
  ENSP ID: ENSP00000476699
MSGNRRQPSRRGQTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLS

SEQ ID NO: 73572 - protein, 214 aa, Homo sapiens
  Payload ID: 14556
  Gene Symbol: ARHGEF2
  Gene Name: Rho/Rac guanine nucleotide exchange factor (GEF) 2
  ENSP ID: ENSP00000476724
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIY

SEQ ID NO: 73573 - protein, 1031 aa, Homo sapiens
  Payload ID: 14556
  Gene Symbol: ARHGEF2
  Gene Name: Rho/Rac guanine nucleotide exchange factor (GEF) 2
  ENSP ID: ENSP00000476916
MLSKSVPVSGINCLLDRSDTDGNVSQSSAIDLRKRCSQLEGHSGTRVGSSLRQTFSFLSGMTGKAKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 73574 - protein, 229 aa, Homo sapiens
  Payload ID: 14556
  Gene Symbol: ARHGEF2
  Gene Name: Rho/Rac guanine nucleotide exchange factor (GEF) 2
  ENSP ID: ENSP00000477299
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKI

SEQ ID NO: 73575 - protein, 59 aa, Homo sapiens
  Payload ID: 14556
  Gene Symbol: ARHGEF2
  Gene Name: Rho/Rac guanine nucleotide exchange factor (GEF) 2
  ENSP ID: ENSP00000477448
QQKAALLKNNTALQSVSLRSKNISMMSLPWGCAGSSHSPQTPSTCGTEPYPWNPSLTKR

SEQ ID NO: 73576 - protein, 1354 aa, Homo sapiens
  Payload ID: 14557
  Gene Symbol: ROCK1
  Gene Name: Rho-associated, coiled-coil containing protein kinase 1
  Uniprot ID: Q13464
  ENSP ID: ENSP00000382697
MSTGDSFETRFEKMDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGEEETFPIPKAFVGNQLPFVGFTYYSNRRYLSSANPNDNRTSSNADKSLQESLQKTIYKLEEQLHNEMQLKDEMEQKCRTSNIKLDKIMKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFQNHKGHEFIPTLYHFPANCDACAKPLWHVFKPPPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTS

SEQ ID NO: 73577 - protein, 99 aa, Homo sapiens
  Payload ID: 14557
  Gene Symbol: ROCK1
  Gene Name: Rho-associated, coiled-coil containing protein kinase 1
  ENSP ID: ENSP00000462004
PPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTR

SEQ ID NO: 73578 - protein, 1137 aa, Homo sapiens
  Payload ID: 14557
  Gene Symbol: ROCK1
  Gene Name: Rho-associated, coiled-coil containing protein kinase 1
  ENSP ID: ENSP00000489185
MSTGDSFETRFEKMDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGEEETFPIPKAFVGNQLPFVGFTYYSNRRYLSSANPNDNRTSSNADKSLQESLQKTIYKLEEQLHNEMQLKDEMEQKCRTSNIKLDKIMKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPVDSACIPYLFIFYSCLLVKN

SEQ ID NO: 73579 - protein, 446 aa, Homo sapiens
  Payload ID: 14558
  Gene Symbol: ROCK2
  Gene Name: Rho-associated, coiled-coil containing protein kinase 2
  ENSP ID: ENSP00000261535
MSRPPPTGKMPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEVC

SEQ ID NO: 73580 - protein, 1388 aa, Homo sapiens
  Payload ID: 14558
  Gene Symbol: ROCK2
  Gene Name: Rho-associated, coiled-coil containing protein kinase 2
  Uniprot ID: O75116
  ENSP ID: ENSP00000317985
MSRPPPTGKMPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKRNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 73581 - protein, 1145 aa, Homo sapiens
  Payload ID: 14558
  Gene Symbol: ROCK2
  Gene Name: Rho-associated, coiled-coil containing protein kinase 2
  ENSP ID: ENSP00000385509
MVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKRNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 73582 - protein, 203 aa, Homo sapiens
  Payload ID: 14558
  Gene Symbol: ROCK2
  Gene Name: Rho-associated, coiled-coil containing protein kinase 2
  ENSP ID: ENSP00000395957
MKAEDYDVVKVIGRGAFGEVQLVRHKASQKVYAMKLLSKFEMIKRSDSAFFWEERDIMAFANSPWVVQTGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELS

SEQ ID NO: 73583 - protein, 703 aa, Homo sapiens
  Payload ID: 14558
  Gene Symbol: ROCK2
  Gene Name: Rho-associated, coiled-coil containing protein kinase 2
  ENSP ID: ENSP00000481789
MEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 73584 - protein, 348 aa, Homo sapiens [sequence omitted]

SEQ ID NO: 73585 - protein, 855 aa, Homo sapiens
  Payload ID: 14560
  Gene Symbol: RHBDF1
  Gene Name: rhomboid 5 homolog 1 (Drosophila)
  Uniprot ID: Q96CC6
  ENSP ID: ENSP00000262316
MSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSSTLAVWVKWPIHPSAPELAGHKRQFGSVCHQDPRVCDEPSSEDPHEWPEDITKWPICTKNSAGNHTNHPHMDCVITGRPCCIGTKGRCEITSREYCDFMRGYFHEEATLCSQVHCMDDVCGLLPFLNPEVPDQFYRLWLSLFLHAGILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 73586 - protein, 137 aa, Homo sapiens
  Payload ID: 14560
  Gene Symbol: RHBDF1
  Gene Name: rhomboid 5 homolog 1 (Drosophila)
  ENSP ID: ENSP00000394427
MSEARRDSTSSLQRKKPPWLKLDIPSAVPLTAEEPSFLQPLRRQAFLRSVSMPAETAHISSPHHELRRPVLQRQTSITQTIRSRQVRFGRVHTLPLLGPRAARRAFPQRQSLSWSLLRGTADWFGVSKDSDSTQKWQ

SEQ ID NO: 73587 - protein, 232 aa, Homo sapiens
  Payload ID: 14560
  Gene Symbol: RHBDF1
  Gene Name: rhomboid 5 homolog 1 (Drosophila)
  ENSP ID: ENSP00000406397
  MOD_RES (1)..(1): Any amino acid
XRPCCIGTKGRCEITSREYCDFMRGYFHEEATLCSQVHCMDDVCGLLPFLNPEMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 73588 - protein, 162 aa, Homo sapiens
  Payload ID: 14560
  Gene Symbol: RHBDF1
  Gene Name: rhomboid 5 homolog 1 (Drosophila)
  ENSP ID: ENSP00000408915
MSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARG

SEQ ID NO: 73589 - protein, 188 aa, Homo sapiens
  Payload ID: 14560
  Gene Symbol: RHBDF1
  Gene Name: rhomboid 5 homolog 1 (Drosophila)
  ENSP ID: ENSP00000411508
MSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKLPLRFPPAPAAAQARVGGQDELPGGRSADERPLR

SEQ ID NO: 73590 - protein, 88 aa, Homo sapiens
  Payload ID: 14560
  Gene Symbol: RHBDF1
  Gene Name: rhomboid 5 homolog 1 (Drosophila)
  ENSP ID: ENSP00000412218
MSEARRDSTSSLQRKKPPWLKLDIPSAVPLTAEEPSFLQPLRRQAFLRSVSMPAETAHISSPHHELRRPVLQRQTSITQTIRRPWSLE

SEQ ID NO: 73591 - protein, 856 aa, Homo sapiens
  Payload ID: 14561
  Gene Symbol: RHBDF2
  Gene Name: rhomboid 5 homolog 2 (Drosophila)
  Uniprot ID: Q6PJF5
  ENSP ID: ENSP00000322775
MASADKNGGSVSSVSSSRLQSRKPPNLSITIPPPEKETQAPGEQDSMLPEGFQNRRLKKSQPRTWAAHTTACPPSFLPKRKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPKIVDPLARGRAFRHPEEMDRPHAPHPPLTPGVLSLTSFTSVRSGYSHLPRRKRMSVAHMSLQAAAALLKGRSVLDATGQRCRVVKRSFAFPSFLEEDVVDGADTFDSSFFSKEEMSSMPDDVFESPPLSASYFRGIPHSASPVSPDGVQIPLKEYGRAPVPGPRRGKRIASKVKHFAFDRKKRHYGLGVVGNWLNRSYRRSISSTVQRQLESFDSHRPYFTYWLTFVHVIITLLVICTYGIAPVGFAQHVTTQLVLRNKGVYESVKYIQQENFWVGPSSIDLIHLGAKFSPCIRKDGQIEQLVLRERDLERDSGCCVQNDHSGCIQTQRKDCSETLATFVKWQDDTGPPMDKSDLGQKRTSGAVCHQDPRTCEEPASSGAHIWPDDITKWPICTEQARSNHTGFLHMDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVGPAGSQFGLLACLFVELFQSWPLLERPWKAFLNLSAIVLFLFICGLLPWIDNIAHIFGFLSGLLLAFAFLPYITFGTSDKYRKRALILVSLLAFAGLFAALVLWLYIYPINWPWIEHLTCFPFTSRFCEKYELDQVLH

SEQ ID NO: 73592 - protein, 74 aa, Homo sapiens
  Payload ID: 14561
  Gene Symbol: RHBDF2
  Gene Name: rhomboid 5 homolog 2 (Drosophila)
  ENSP ID: ENSP00000464942
MASADKNGGSVSSVSSSRLQSRKPPNLSITIPPPEKETQAPGEQDSMLPERKNPAYLKSVSLQEPRSRWQESSE

SEQ ID NO: 73593 - protein, 28 aa, Homo sapiens
  Payload ID: 14561
  Gene Symbol: RHBDF2
  Gene Name: rhomboid 5 homolog 2 (Drosophila)
  ENSP ID: ENSP00000464975
MASADKNGGSVSSVSSSRLQSRKPPNLS

SEQ ID NO: 73594 - protein, 13 aa, Homo sapiens
  Payload ID: 14561
  Gene Symbol: RHBDF2
  Gene Name: rhomboid 5 homolog 2 (Drosophila)
  ENSP ID: ENSP00000465124
MASADKNGGSVSS

SEQ ID NO: 73595 - protein, 73 aa, Homo sapiens
  Payload ID: 14561
  Gene Symbol: RHBDF2
  Gene Name: rhomboid 5 homolog 2 (Drosophila)
  ENSP ID: ENSP00000465531
MASADKNGGSVSSVSSSRLQSRKPPNLSITIPPPEKETQAPGEQDSMLPERKNPAYLKSVSLQEPRSRWQESS

SEQ ID NO: 73596 - protein, 112 aa, Homo sapiens
  Payload ID: 14561
  Gene Symbol: RHBDF2
  Gene Name: rhomboid 5 homolog 2 (Drosophila)
  ENSP ID: ENSP00000465632
MASADKNGGSVSSVSSSRLQSRKPPNLSITIPPPEKETQAPGEQDSMLPERKNPAYLKSVSLQEPRSRWQESSEKRPGFRRQASLSQSIRKGAAQWFGVSGDWEGQRQQWQR

SEQ ID NO: 73597 - protein, 26 aa, Homo sapiens
  Payload ID: 14561
  Gene Symbol: RHBDF2
  Gene Name: rhomboid 5 homolog 2 (Drosophila)
  ENSP ID: ENSP00000465990
MASADKNGGSVSSVSSSRLQSRKPPN

SEQ ID NO: 73598 - protein, 47 aa, Homo sapiens
  Payload ID: 14561
  Gene Symbol: RHBDF2
  Gene Name: rhomboid 5 homolog 2 (Drosophila)
  ENSP ID: ENSP00000466029
MASADKNGGSVSSVSSSRLQSRKPPNLSITIPPPEKETQAPGEQDSM

SEQ ID NO: 73599 - protein, 827 aa, Homo sapiens
  Payload ID: 14561
  Gene Symbol: RHBDF2
  Gene Name: rhomboid 5 homolog 2 (Drosophila)
  Uniprot ID: Q6PJF5
  ENSP ID: ENSP00000466867
MASADKNGGSVSSVSSSRLQSRKPPNLSITIPPPEKETQAPGEQDSMLPERKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPKIVDPLARGRAFRHPEEMDRPHAPHPPLTPGVLSLTSFTSVRSGYSHLPRRKRMSVAHMSLQAAAALLKGRSVLDATGQRCRVVKRSFAFPSFLEEDVVDGADTFDSSFFSKEEMSSMPDDVFESPPLSASYFRGIPHSASPVSPDGVQIPLKEYGRAPVPGPRRGKRIASKVKHFAFDRKKRHYGLGVVGNWLNRSYRRSISSTVQRQLESFDSHRPYFTYWLTFVHVIITLLVICTYGIAPVGFAQHVTTQLVLRNKGVYESVKYIQQENFWVGPSSIDLIHLGAKFSPCIRKDGQIEQLVLRERDLERDSGCCVQNDHSGCIQTQRKDCSETLATFVKWQDDTGPPMDKSDLGQKRTSGAVCHQDPRTCEEPASSGAHIWPDDITKWPICTEQARSNHTGFLHMDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVGPAGSQFGLLACLFVELFQSWPLLERPWKAFLNLSAIVLFLFICGLLPWIDNIAHIFGFLSGLLLAFAFLPYITFGTSDKYRKRALILVSLLAFAGLFAALVLWLYIYPINWPWIEHLTCFPFTSRFCEKYELDQVLH

SEQ ID NO: 73600 - protein, 86 aa, Homo sapiens
  Payload ID: 14561
  Gene Symbol: RHBDF2
  Gene Name: rhomboid 5 homolog 2 (Drosophila)
  ENSP ID: ENSP00000467468
LPFLNPEVPDQFYRLWLSLFLHAGVVHCLVSVVFQMTILRDLEKLAGWHRIAIIFILSGITGNLASAIFLPYRAEPQGSPCLPGRS

SEQ ID NO: 73601 - protein, 185 aa, Homo sapiens
  Payload ID: 14561
  Gene Symbol: RHBDF2
  Gene Name: rhomboid 5 homolog 2 (Drosophila)
  ENSP ID: ENSP00000467549
MASADKNGGSVSSVSSSRLQSRKPPNLSITIPPPEKETQAPGEQDSMLPEGFQNRRLKKSQPRTWAAHTTACPPSFLPKRKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPK

SEQ ID NO: 73602 - protein, 89 aa, Homo sapiens
  Payload ID: 14561
  Gene Symbol: RHBDF2
  Gene Name: rhomboid 5 homolog 2 (Drosophila)
  ENSP ID: ENSP00000467677
MASADKNGGSVSSVSSSRLQSRKPPNLSITIPPPEKETQAPGEQDSMLPERKNPAYLKSVSLQEPRSRWQESSEKRPGFRRQASLSQSI

SEQ ID NO: 73603 - protein, 47 aa, Homo sapiens; identical to SEQ ID NO: 73598
  Payload ID: 14561
  Gene Symbol: RHBDF2
  Gene Name: rhomboid 5 homolog 2 (Drosophila)
  ENSP ID: ENSP00000467971

SEQ ID NO: 73604 - protein, 315 aa, Homo sapiens
  Payload ID: 14562
  Gene Symbol: RHBDD1
  Gene Name: rhomboid domain containing 1
  Uniprot ID: Q8TEB9
  ENSP ID: ENSP00000344779
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALKVLNNHYCPGGFVNILGFPVPNRFACWVELVAIHLFSPGTSFAGHLAGILVGLMYTQGPLKKIMEACAGGFSSSVGYPGRQYYFNSSGSSGYQDYYPHGRPDHYEEAPRNYDTYTAGLSEEEQLERALQASLWDRGNTRNSPPPYGFHLSPEEMRRQRLHRFDSQ

SEQ ID NO: 73605 - protein, 315 aa, Homo sapiens; identical to SEQ ID NO: 73604
  Payload ID: 14562
  Gene Symbol: RHBDD1
  Gene Name: rhomboid domain containing 1
  Uniprot ID: Q8TEB9
  ENSP ID: ENSP00000375914

SEQ ID NO: 73606 - protein, 157 aa, Homo sapiens
  Payload ID: 14562
  Gene Symbol: RHBDD1
  Gene Name: rhomboid domain containing 1
  ENSP ID: ENSP00000387269
MRRQNVSNQQQNKHSQRVSFPPRTSFAGHLAGILVGLMYTQGPLKKIMEACAGGFSSSVGYPGRQYYFNSSGSSGYQDYYPHGRPDHYEEAPRNYDTYTAGLSEEEQLERALQASLWDRGKPGHKETMASLLDPKIKVRTDKGPRCLGSLKQAAVWT

SEQ ID NO: 73607 - protein, 124 aa, Homo sapiens
  Payload ID: 14562
  Gene Symbol: RHBDD1
  Gene Name: rhomboid domain containing 1
  ENSP ID: ENSP00000388847
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQF

SEQ ID NO: 73608 - protein, 54 aa, Homo sapiens
  Payload ID: 14562
  Gene Symbol: RHBDD1
  Gene Name: rhomboid domain containing 1
  ENSP ID: ENSP00000397298
MQRRSRGINTGLILLLSQIFHVGINNIPPVTLATLALNIWFFLNPQKPLYSSCL

SEQ ID NO: 73609 - protein, 151 aa, Homo sapiens
  Payload ID: 14562
  Gene Symbol: RHBDD1
  Gene Name: rhomboid domain containing 1
  ENSP ID: ENSP00000399694
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALK

SEQ ID NO: 73610 - protein, 134 aa, Homo sapiens
  Payload ID: 14562
  Gene Symbol: RHBDD1
  Gene Name: rhomboid domain containing 1
  ENSP ID: ENSP00000400765
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPD

SEQ ID NO: 73611 - protein, 50 aa, Homo sapiens
  Payload ID: 14562
  Gene Symbol: RHBDD1
  Gene Name: rhomboid domain containing 1
  ENSP ID: ENSP00000410384
MQRRSRGINTGLILLLSQIFHVGINNIPPVTLATLALNIWFFLNPQKPLY

SEQ ID NO: 73612 - protein, 6 aa, Homo sapiens
  Payload ID: 14562
  Gene Symbol: RHBDD1
  Gene Name: rhomboid domain containing 1
  ENSP ID: ENSP00000414801
MQRRSR

SEQ ID NO: 73613 - protein, 364 aa, Homo sapiens
  Payload ID: 14563
  Gene Symbol: RHBDD2
  Gene Name: rhomboid domain containing 2
  Uniprot ID: Q6NTF9
  ENSP ID: ENSP00000006777
MAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSHPVSQTQHASGQKLASWPSCTPGHMPTLPPYQPASGLCYVQNHFGPNPTSSSVYPASAGTSLGIQPPTPVNSPGTVYSGALGTPGAAGSKESSRVPMP

SEQ ID NO: 73614 - protein, 223 aa, Homo sapiens
  Payload ID: 14563
  Gene Symbol: RHBDD2
  Gene Name: rhomboid domain containing 2
  Uniprot ID: Q6NTF9
  ENSP ID: ENSP00000314144
MLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSHPVSQTQHASGQKLASWPSCTPGHMPTLPPYQPASGLCYVQNHFGPNPTSSSVYPASAGTSLGIQPPTPVNSPGTVYSGALGTPGAAGSKESSRVPMP

SEQ ID NO: 73615 - protein, 223 aa, Homo sapiens; identical to SEQ ID NO: 73614
  Payload ID: 14563
  Gene Symbol: RHBDD2
  Gene Name: rhomboid domain containing 2
  Uniprot ID: Q6NTF9
  ENSP ID: ENSP00000391232

SEQ ID NO: 73616 - protein, 79 aa, Homo sapiens
  Payload ID: 14563
  Gene Symbol: RHBDD2
  Gene Name: rhomboid domain containing 2
  ENSP ID: ENSP00000403507
MAASGPGCRSWCLCPEVPSATFFTALLSLLVSGPRLFLLQQPLAPSGLTLKSEALRNWQATMEGGVRITAEETGTQSVK

SEQ ID NO: 73617 - protein, 386 aa, Homo sapiens
  Payload ID: 14564
  Gene Symbol: RHBDD3
  Gene Name: rhomboid domain containing 3
  Uniprot ID: Q9Y3P4
  ENSP ID: ENSP00000216085
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVQPTWEGSSEAGLDWAGASFSPGTPMWAALDEQMLQEGIQASLLDGPAQEPQSAPWLSKSSVSSLRLQQLERMGFPTEQAVVALAATGRVEGAVSLLVGGQVGTETLVTHGKGGPAHSEGPGPP

SEQ ID NO: 73618 - protein, 136 aa, Homo sapiens
  Payload ID: 14564
  Gene Symbol: RHBDD3
  Gene Name: rhomboid domain containing 3
  ENSP ID: ENSP00000384113
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRP

SEQ ID NO: 73619 - protein, 89 aa, Homo sapiens
  Payload ID: 14564
  Gene Symbol: RHBDD3
  Gene Name: rhomboid domain containing 3
  ENSP ID: ENSP00000399550
MHARGPHGQLSPALPLASSVLMLLMSTLWLVGAGPGLVLAPELLLDPWQETGSMLPRLVLNSWPQVILPSQPPQVLGLYSCEPLRPALR

SEQ ID NO: 73620 - protein, 195 aa, Homo sapiens
  Payload ID: 14564
  Gene Symbol: RHBDD3
  Gene Name: rhomboid domain containing 3
  ENSP ID: ENSP00000413128
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQV

SEQ ID NO: 73621 - protein, 438 aa, Homo sapiens
  Payload ID: 14565
  Gene Symbol: RHBDL1
  Gene Name: rhomboid, veinlet-like 1 (Drosophila)
  Uniprot ID: O75783
  ENSP ID: ENSP00000219551
MGRVEDGGTTEELEDWDPGTSALPAPGIKQGPREQTGTGPLSQKCWEPEPDAPSQPGPALWSRGRARTQALAGGSSLQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 73622 - protein, 373 aa, Homo sapiens
  Payload ID: 14565
  Gene Symbol: RHBDL1
  Gene Name: rhomboid, veinlet-like 1 (Drosophila)
  Uniprot ID: O75783
  ENSP ID: ENSP00000344206
MDRSSLLQLIQEQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 73623 - protein, 229 aa, Homo sapiens
  Payload ID: 14565
  Gene Symbol: RHBDL1
  Gene Name: rhomboid, veinlet-like 1 (Drosophila)
  ENSP ID: ENSP00000455608
MDRSSLLQLIQEQQLDPENTGFIGADTFTGLVHSHELPLDPAKLDMLVALAQSNEQGQVCYQELVDLIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASG

SEQ ID NO: 73624 - protein, 303 aa, Homo sapiens
  Payload ID: 14566
  Gene Symbol: RHBDL2
  Gene Name: rhomboid, veinlet-like 2 (Drosophila)
  Uniprot ID: Q9NX52
  ENSP ID: ENSP00000289248
MAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSFAAHIAGGFAGMSIGYTVFSCFDKALLKDPRFWIAIAAYLACVLFAVFFNIFLSPAN

SEQ ID NO: 73625 - protein, 303 aa, Homo sapiens; identical to SEQ ID NO: 73624
  Payload ID: 14566
  Gene Symbol: RHBDL2
  Gene Name: rhomboid, veinlet-like 2 (Drosophila)
  Uniprot ID: Q9NX52
  ENSP ID: ENSP00000362081

SEQ ID NO: 73626 - protein, 132 aa, Homo sapiens
  Payload ID: 14566
  Gene Symbol: RHBDL2
  Gene Name: rhomboid, veinlet-like 2 (Drosophila)
  Uniprot ID: Q9NX52
  ENSP ID: ENSP00000441097
MAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAG

SEQ ID NO: 73627 - protein, 404 aa, Homo sapiens
  Payload ID: 14567
  Gene Symbol: RHBDL3
  Gene Name: rhomboid, veinlet-like 3 (Drosophila)
  Uniprot ID: P58872
  ENSP ID: ENSP00000269051
MGEHPSPGPAVAACAEAERIEELEPEAEERLPAAPEDHWKVLFDQFDPGNTGYISTGKFRSLLESHSSKLDPHKREVLLALADSHADGQIGYQDFVSLMSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAGSLAVSVADMTAPVVGSSGGVYALVSAHLANIVMNWSGMKCQFKLLRMAVALICMSMEFGRAVWLRFHPSAYPPCPHPSFVAHLGGVAVGITLGVVVLRNYEQRLQDQSLWWIFVAMYTVFVLFAVFWNIFAYTLLDLKLPPPP

SEQ ID NO: 73628 - protein, 416 aa, Homo sapiens
  Payload ID: 14567
  Gene Symbol: RHBDL3
  Gene Name: rhomboid, veinlet-like 3 (Drosophila)
  ENSP ID: ENSP00000394849
MGEHPSPGPAVAACAEAERIEELEPEAEERLPAAPEDHWKVLFDQFDPGNTGYISTGKFRSLLESHSSKLDPHKREVLLALADSHADGQIGYQDFVSLMSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAELVRHEVPVQAAADGCGPYLYEHGVWAGRVAPLPPVGLSPVPSPKLCGALGWRGRGHHPGRGGPEELRAEAPGPVTVVDFCGHVHRLRAVRCLLEHLCLHPAGLKAAASPLRAGGPRSGRGGKSSTHRERLRGFFSSPAQLGRADKDRRLWATVMF

SEQ ID NO: 73629 - protein, 396 aa, Homo sapiens
  Payload ID: 14567
  Gene Symbol: RHBDL3
  Gene Name: rhomboid, veinlet-like 3 (Drosophila)
  Uniprot ID: P58872
  ENSP ID: ENSP00000442092
MGEHPSPGPAVAACAEAERIEELEPEAEERLPAAPEDFDPGNTGYISTGKFRSLLESHSSKLDPHKREVLLALADSHADGQIGYQDFVSLMSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAGSLAVSVADMTAPVVGSSGGVYALVSAHLANIVMNWSGMKCQFKLLRMAVALICMSMEFGRAVWLRFHPSAYPPCPHPSFVAHLGGVAVGITLGVVVLRNYEQRLQDQSLWWIFVAMYTVFVLFAVFWNIFAYTLLDLKLPPPP

SEQ ID NO: 73630 - protein, 51 aa, Homo sapiens
  Payload ID: 14567
  Gene Symbol: RHBDL3
  Gene Name: rhomboid, veinlet-like 3 (Drosophila)
  ENSP ID: ENSP00000463941
MGEHPSPGPAVAACAEAERIEELEPEAEERLPAAPEDHWKVLFDQEAFLDL

SEQ ID NO: 73631 - protein, 306 aa, Homo sapiens
  Payload ID: 14567
  Gene Symbol: RHBDL3
  Gene Name: rhomboid, veinlet-like 3 (Drosophila)
  Uniprot ID: P58872
  ENSP ID: ENSP00000466508
MSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAGSLAVSVADMTAPVVGSSGGVYALVSAHLANIVMNWSGMKCQFKLLRMAVALICMSMEFGRAVWLRFHPSAYPPCPHPSFVAHLGGVAVGITLGVVVLRNYEQRLQDQSLWWIFVAMYTVFVLFAVFWNIFAYTLLDLKLPPPP

SEQ ID NO: 73632 - protein, 212 aa, Homo sapiens
  Payload ID: 14568
  Gene Symbol: ROPN1
  Gene Name: rhophilin associated tail protein 1
  Uniprot ID: Q9HAT0
  ENSP ID: ENSP00000184183
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEEIEWLKFLALACSALGVTITKTLKIVCEVLSCDHNGGSPRIPFSTFQFLYTYIAKVDGEISASHVSRMLNYMEQEVIGPDGIITVNDFTQNPRVQLE

SEQ ID NO: 73633 - protein, 212 aa, Homo sapiens; identical to SEQ ID NO: 73632
  Payload ID: 14568
  Gene Symbol: ROPN1
  Gene Name: rhophilin associated tail protein 1
  Uniprot ID: Q9HAT0
  ENSP ID: ENSP00000385919

SEQ ID NO: 73634 - protein, 129 aa, Homo sapiens
  Payload ID: 14568
  Gene Symbol: ROPN1
  Gene Name: rhophilin associated tail protein 1
  ENSP ID: ENSP00000417067
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEEIEWLKFLALACSA

SEQ ID NO: 73635 - protein, 58 aa, Homo sapiens
  Payload ID: 14568
  Gene Symbol: ROPN1
  Gene Name: rhophilin associated tail protein 1
  Uniprot ID: Q9HAT0
  ENSP ID: ENSP00000417379
MAQTDKPTCIPPELPKMLKEFAKAAIRVQPQDLIQWAAEYVLLSRLHPLEDGRRQRVL

SEQ ID NO: 73636 - protein, 77 aa, Homo sapiens
  Payload ID: 14568
  Gene Symbol: ROPN1
  Gene Name: rhophilin associated tail protein 1
  ENSP ID: ENSP00000418931
MAQTDKPTCIPPELPKMLKEFAKAAIRVQPQDLIQWAADYFEALSRGETPPVRERSERVALCNRAELTPELLKILHS

SEQ ID NO: 73637 - protein, 58 aa, Homo sapiens; identical to SEQ ID NO: 73635
  Payload ID: 14568
  Gene Symbol: ROPN1
  Gene Name: rhophilin associated tail protein 1
  Uniprot ID: Q9HAT0
  ENSP ID: ENSP00000419205

SEQ ID NO: 73638 - protein, 116 aa, Homo sapiens
  Payload ID: 14568
  Gene Symbol: ROPN1
  Gene Name: rhophilin associated tail protein 1
  ENSP ID: ENSP00000420310
MAQTDKPTCIPPELPKMLKEFAKAAIRVQPQDLIQWAADYFEALSRGETPPVRERSERVALCNRAELTPELLKILHSQVAGRLIIRAEELAQMWKVVNLPTDLFNSVMNVGRFTEE

SEQ ID NO: 73639 - protein, 58 aa, Homo sapiens; identical to SEQ ID NO: 73635
  Payload ID: 14568
  Gene Symbol: ROPN1
  Gene Name: rhophilin associated tail protein 1
  Uniprot ID: Q9HAT0
  ENSP ID: ENSP00000420567

SEQ ID NO: 73640 - protein, 58 aa, Homo sapiens; identical to SEQ ID NO: 73635
  Payload ID: 14568
  Gene Symbol: ROPN1
  Gene Name: rhophilin associated tail protein 1
  Uniprot ID: Q9HAT0
  ENSP ID: ENSP00000420590

SEQ ID NO: 73641 - protein, 212 aa, Homo sapiens; identical to SEQ ID NO: 73632
  Payload ID: 14568
  Gene Symbol: ROPN1
  Gene Name: rhophilin associated tail protein 1
  Uniprot ID: Q9HAT0
  ENSP ID: ENSP00000483603

SEQ ID NO: 73642 - protein, 212 aa, Homo sapiens
  Payload ID: 14569
  Gene Symbol: ROPN1B
  Gene Name: rhophilin associated tail protein 1B
  Uniprot ID: Q9BZX4
  ENSP ID: ENSP00000251776
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTDLFNSVMNVGRFTEEIEWLKFLALACSALGVTITKTLKIVCEVLSCDHNGGLPRIPFSTFQFLYTYIAEVDGEICASHVSRMLNYIEQEVIGPDGLITVNDFTQNPRVWLE

SEQ ID NO: 73643 - protein, 120 aa, Homo sapiens
  Payload ID: 14569
  Gene Symbol: ROPN1B
  Gene Name: rhophilin associated tail protein 1B
  Uniprot ID: Q9BZX4
  ENSP ID: ENSP00000421662
MWKVVNLPTDLFNSVMNVGRFTEEIEWLKFLALACSALGVTITKTLKIVCEVLSCDHNGGLPRIPFSTFQFLYTYIAEVDGEICASHVSRMLNYIEQEVIGPDGLITVNDFTQNPRVWLE

SEQ ID NO: 73644 - protein, 102 aa, Homo sapiens
  Payload ID: 14569
  Gene Symbol: ROPN1B
  Gene Name: rhophilin associated tail protein 1B
  ENSP ID: ENSP00000423058
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTD

SEQ ID NO: 73645 - protein, 120 aa, Homo sapiens; identical to SEQ ID NO: 73643
  Payload ID: 14569
  Gene Symbol: ROPN1B
  Gene Name: rhophilin associated tail protein 1B
  Uniprot ID: Q9BZX4
  ENSP ID: ENSP00000424447

SEQ ID NO: 73646 - protein, 58 aa, Homo sapiens
  Payload ID: 14569
  Gene Symbol: ROPN1B
  Gene Name: rhophilin associated tail protein 1B
  ENSP ID: ENSP00000424457
MAQTDKPTCIPPELPKMLKEFAKAAIRAQPQDLIQWGAEYVLLSRLHLLEDGRGERVL

SEQ ID NO: 73647 - protein, 130 aa, Homo sapiens
  Payload ID: 14569
  Gene Symbol: ROPN1B
  Gene Name: rhophilin associated tail protein 1B
  ENSP ID: ENSP00000425548
MAQTDKPTCIPPELPKMLKEFAKAAIRAQPQDLIQWGADYFEALSRGETPPVRERSERVALCNWAELTPELLKILHSQVAGRLIIRAEELAQMWKVVNLPTDLFNSVMNVGRFTEEIEWLKFLALACSAL

SEQ ID NO: 73648 - protein, 212 aa, Homo sapiens; identical to SEQ ID NO: 73642
  Payload ID: 14569
  Gene Symbol: ROPN1B
  Gene Name: rhophilin associated tail protein 1B
  Uniprot ID: Q9BZX4
  ENSP ID: ENSP00000426271

SEQ ID NO: 73649 - protein, 230 aa, Homo sapiens
  Payload ID: 14570
  Gene Symbol: ROPN1L
  Gene Name: rhophilin associated tail protein 1-like
  Uniprot ID: Q96C74
  ENSP ID: ENSP00000274134
MPLPDTMFCAQQIHIPPELPDILKQFTKAAIRTQPADVLRWSAGYFSALSRGDPLPVKDRMEMPTATQKTDTGLTQGLLKVLHKQCHHKRYVELTDLEQKWKNLCLPKEKFKALLQLDPCENKIKWINFLALGCSMLGGSLNTALKHLCEILTDDPEGGPARIPFKTFSYVYRYLARLDSDVSPLETESYLASLKENIDARKNGMIGLSDFFFPKRKLLESIENSEDVGH

SEQ ID NO: 73650 - protein, 230 aa, Homo sapiens; identical to SEQ ID NO: 73649
  Payload ID: 14570
  Gene Symbol: ROPN1L
  Gene Name: rhophilin associated tail protein 1-like
  Uniprot ID: Q96C74
  ENSP ID: ENSP00000421405

SEQ ID NO: 73651 - protein, 670 aa, Homo sapiens
  Payload ID: 14571
  Gene Symbol: RHPN1
  Gene Name: rhophilin, Rho GTPase binding protein 1
  Uniprot ID: Q8TCX5
  ENSP ID: ENSP00000289013
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSPATEGELPTHEQVFLQPPTSSKPRGPVLPQELEERRQLGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 73652 - protein, 695 aa, Homo sapiens
  Payload ID: 14571
  Gene Symbol: RHPN1
  Gene Name: rhophilin, Rho GTPase binding protein 1
  Uniprot ID: Q8TCX5
  ENSP ID: ENSP00000484724
MILEERPDGAGAGEESPRLQGCDSLTQIQCGQLQSRRAQIHQQIDKELQMRTGAENLYRATSNNRVRETVALELSYVNSNLQLLKEELEELSGGVDPGRHGSEAVTVPMIPLGLKETKELDWSTPLKELISVHFGEDGASYEAEIRELEALRQAMRTPSRNESGLELLTAYYNQLCFLDARFLTPARSLGLFFHWYDSLTGVPAQQRALAFEKGSVLFNIGALHTQIGARQDRSCTEGARRAMEAFQRAAGAFSLLRENFSHAPSPDMSAASLCALEQLMMAQAQECVFEGLSPPASMAPQDCLAQLRLAQEAAQVAAEYRLVHRTMAQPPVHDYVPVSWTALVHVKAEYFRSLAHYHVAMALCDGSRECPPHLPMVLPRPPRAGSQPLCPPAATEGELPTHEQVFLQPPTSSKPRGPVLPQELEERRQLGKAHLKRAILGQEEALRLHALCRVLREVDLLRAVISQTLQRSLAKYAELDREDDFCEAAEAPDIQPKTHQKPEARMPRLSQGKGPDIFHRLGPLSVFSAKNRWRLVGPVHLTRGEGGFGLTLRGDSPVLIAAVIPGSQAAAAGLKEGDYIVSVNGQPCRWWRHAEVVTELKAAGEAGASLQVVSLLPSSRLPSLGDRRPVLLGPRGLLRSQREHGCKTPASTWASPRPLLNWSRKAQQGKTGGCPQPCAPVKPAPPSSLKHPGWP

SEQ ID NO: 73653 - protein, 686 aa, Homo sapiens
  Payload ID: 14572
  Gene Symbol: RHPN2
  Gene Name: rhophilin, Rho GTPase binding protein 2
  Uniprot ID: Q8IUC4
  ENSP ID: ENSP00000254260
MTDALLPAAPQPLEKENDGYFRKGCNPLAQTGRSKLQNQRAALNQQILKAVRMRTGAENLLKVATNSKVREQVRLELSFVNSDLQMLKEELEGLNISVGVYQNTEEAFTIPLIPLGLKETKDVDFAVVLKDFILEHYSEDGYLYEDEIADLMDLRQACRTPSRDEAGVELLMTYFIQLGFVESRFFPPTRQMGLLFTWYDSLTGVPVSQQNLLLEKASVLFNTGALYTQIGTRCDRQTQAGLESAIDAFQRAAGVLNYLKDTFTHTPSYDMSPAMLSVLVKMMLAQAQESVFEKISLPGIRNEFFMLVKVAQEAAKVGEVYQQLHAAMSQAPVKENIPYSWASLACVKAHHYAALAHYFTAILLIDHQVKPGTDLDHQEKCLSQLYDHMPEGLTPLATLKNDQQRRQLGKSHLRRAMAHHEESVREASLCKKLRSIEVLQKVLCAAQERSRLTYAQHQEEDDLLNLIDAPSVVAKTEQEVDIILPQFSKLTVTDFFQKLGPLSVFSANKRWTPPRSIRFTAEEGDLGFTLRGNAPVQVHFLDPYCSASVAGAREGDYIVSIQLVDCKWLTLSEVMKLLKSFGEDEIEMKVVSLLDSTSSMHNKSATYSVGMQKTYSMICLAIDDDDKTDKTKKISKKLSFLSWGTNKNRQKSASTLCLPSVGAARPQVKKKLPSPFSLLNSDSSWY

SEQ ID NO: 73654 - protein, 128 aa, Homo sapiens
  Payload ID: 14572
  Gene Symbol: RHPN2
  Gene Name: rhophilin, Rho GTPase binding protein 2
  ENSP ID: ENSP00000465898
MTDALLPAAPQPLEKENDGYFRKGCNPLAQTGRSKLQNQRAALNQQILKAVRMRTGAENLLKVATNSKVREQVRLELSFVNSDLQMLKEELEGLNISVGVYQNTEILSWNITVKMAIYMKMKLQILWI

SEQ ID NO: 73655 - protein, 696 aa, Homo sapiens
  Payload ID: 14573
  Gene Symbol: RHOBTB1
  Gene Name: Rho-related BTB domain containing 1
  Uniprot ID: O94844
  ENSP ID: ENSP00000338671
MDADMDYERPNVETIKCVVVGDNAVGKTRLICARACNTTLTQYQLLATHVPTVWAIDQYRVCQEVLERSRDVVDEVSVSLRLWDTFGDHHKDRRFAYGRSDVVVLCFSIANPNSLNHVKSMWYPEIKHFCPRTPVILVGCQLDLRYADLEAVNRARRPLARPIKRGDILPPEKGREVAKELGLPYYETSVFDQFGIKDVFDNAIRAALISRRHLQFWKSHLKKVQKPLLQAPFLPPKAPPPVIKIPECPSMGTNEAACLLDNPLCADVLFILQDQEHIFAHRIYLATSSSKFYDLFLMECEESPNGSEGACEKEKQSRDFQGRILSVDPEEEREEGPPRIPQADQWKSSNKSLVEALGLEAEGAVPETQTLTGWSKGFIGMHREMQVNPISKRMGPMTVVRMDASVQPGPFRTLLQFLYTGQLDEKEKDLVGLAQIAEVLEMFDLRMMVENIMNKEAFMNQEITKAFHVRKANRIKECLSKGTFSDVTFKLDDGAISAHKPLLICSCEWMAAMFGGSFVESANSEVYLPNINKISMQAVLDYLYTKQLSPNLDLDPLELIALANRFCLPHLVALAEQHAVQELTKAATSGVGIDGEVLSYLELAQFHNAHQLAAWCLHHICTNYNSVCSKFRKEIKSKSADNQEYFERHRWPPVWYLKEEDHYQRVKREREKEDIALNKHRSRRKWCFWNSSPAVA

SEQ ID NO: 73656 - protein, 696 aa, Homo sapiens; identical to SEQ ID NO: 73655
  Payload ID: 14573
  Gene Symbol: RHOBTB1
  Gene Name: Rho-related BTB domain containing 1
  Uniprot ID: O94844
  ENSP ID: ENSP00000350595

SEQ ID NO: 73657 - protein, 727 aa, Homo sapiens
  Payload ID: 14574
  Gene Symbol: RHOBTB2
  Gene Name: Rho-related BTB domain containing 2
  Uniprot ID: Q9BYZ6
  ENSP ID: ENSP00000251822
MDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLARPIKPNEILPPEKGREVAKELGIPYYETSVVAQFGIKDVFDNAIRAALISRRHLQFWKSHLRNVQRPLLQAPFLPPKPPPPIIVVPDPPSSSEECPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 73658 - protein, 749 aa, Homo sapiens
  Payload ID: 14574
  Gene Symbol: RHOBTB2
  Gene Name: Rho-related BTB domain containing 2
  Uniprot ID: Q9BYZ6
  ENSP ID: ENSP00000427926
MQAWRKGPDGPQKTSSDSMSRLMDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLARPIKPNEILPPEKGREVAKELGIPYYETSVVAQFGIKDVFDNAIRAALISRRHLQFWKSHLRNVQRPLLQAPFLPPKPPPPIIVVPDPPSSSEECPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 73659 - protein, 734 aa, Homo sapiens
  Payload ID: 14574
  Gene Symbol: RHOBTB2
  Gene Name: Rho-related BTB domain containing 2
  Uniprot ID: Q9BYZ6
  ENSP ID: ENSP00000429141
MKARSRLMDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLARPIKPNEILPPEKGREVAKELGIPYYETSVVAQFGIKDVFDNAIRAALISRRHLQFWKSHLRNVQRPLLQAPFLPPKPPPPIIVVPDPPSSSEECPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 73660 - protein, 182 aa, Homo sapiens
  Payload ID: 14574
  Gene Symbol: RHOBTB2
  Gene Name: Rho-related BTB domain containing 2
  ENSP ID: ENSP00000430785
MQAWRKGPDGPQKTSSDSMSRLMDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLA

SEQ ID NO: 73661 - protein, 611 aa, Homo sapiens
  Payload ID: 14575
  Gene Symbol: RHOBTB3
  Gene Name: Rho-related BTB domain containing 3
  Uniprot ID: O94955
  ENSP ID: ENSP00000369318
MSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVLEYFMIQALNQKTSEKMKKRKMSNSFHGIRPPQLEQPEKMPVLKAEASHYNSDLNNLLFCCQCVDVVFYNPNLKKVVEAHKIVLCAVSHVFMLLFNVKSPTDIQDSSIIRTTQDLFAINRDTAFPGASHESSGNPPLRVIVKDALFCSCLSDILRFIYSGAFQWEELEEDIRKKLKDSGDVSNVIEKVKCILKTPGKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 73662 - protein, 103 aa, Homo sapiens
  Payload ID: 14575
  Gene Symbol: RHOBTB3
  Gene Name: Rho-related BTB domain containing 3
  ENSP ID: ENSP00000421875
  MOD_RES (1)..(1): Any amino acid
XDIIVIKYNVNDKFSFHEVKDNYIPVIKRALNSVPVIIAAVGTRQNEELPCTCPLCTSDRGSCVSTTEGIQLAKELGATYLELHSLDDFYIGKYFGGVKKCLS

SEQ ID NO: 73663 - protein, 242 aa, Homo sapiens
  Payload ID: 14575
  Gene Symbol: RHOBTB3
  Gene Name: Rho-related BTB domain containing 3
  ENSP ID: ENSP00000422360
MPKRAVLFTDRQPIQFLKINCLRNCKTYQARKPLWFYNTSLKFFLNKPMLADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVM

SEQ ID NO: 73664 - protein, 72 aa, Homo sapiens
  Payload ID: 14575
  Gene Symbol: RHOBTB3
  Gene Name: Rho-related BTB domain containing 3
  ENSP ID: ENSP00000423652
LVSGDESSLLLNAASTVARPVFTEYQASAFGNVKLVVHDCPVWKSYLVHAHYVPQTEGAVLVQLKGSNLQKN

SEQ ID NO: 73665 - protein, 180 aa, Homo sapiens
  Payload ID: 14575
  Gene Symbol: RHOBTB3
  Gene Name: Rho-related BTB domain containing 3
  ENSP ID: ENSP00000423688
MRKRQTWSIHIVALGNEGDTFHQDNRPSGLIRTYLGRSPLVSGDESSLLLNAASTVARPVFTEYQASAFGNVKLVVHDCPVWDIFDSDWYTSRNLIGGADIIVIKYNVNDKFSFHEVKDNYIPVIKRALNSVPVIIAAVGTRQNEELPCTCPLCTSDRGSCVSTTEGIQLAKELGATYLE

SEQ ID NO: 73666 - protein, 37 aa, Homo sapiens
  Payload ID: 14575
  Gene Symbol: RHOBTB3
  Gene Name: Rho-related BTB domain containing 3
  ENSP ID: ENSP00000424700
  MOD_RES (1)..(1): Any amino acid
XIFSQKPEFQDLSVFFLKLQWKNAVLLKSTDGRRICT

SEQ ID NO: 73667 - protein, 172 aa, Homo sapiens
  Payload ID: 14575
  Gene Symbol: RHOBTB3
  Gene Name: Rho-related BTB domain containing 3
  ENSP ID: ENSP00000424844
  MOD_RES (1)..(1): Any amino acid
XADVVFEIQGTTVPAHRAILVARCEVMAAMFNGNYMEAKSVLIPVYGVSKETFLSFLEYLYTDSCCPAGIFQAMCLLICAEMYQVSRLQHICELFIITQLQSMPSRELASMNLDIVDLLKKAKFHHSDCLSTWLLHFIATNYLIFSQKPEFQDLSGRLLISVLKRKLYVLCS

SEQ ID NO: 73668 - protein, 76 aa, Homo sapiens
  Payload ID: 14575
  Gene Symbol: RHOBTB3
  Gene Name: Rho-related BTB domain containing 3
  ENSP ID: ENSP00000425342
  MOD_RES (1)..(1): Any amino acid
XYLIFSQKPEFQDLSGSFMVKPEYLQRGGAKARAGHHDCHVRGIPSILRSREGKKIHSQKQLFTVTLIVTRIKMAK

SEQ ID NO: 73669 - protein, 117 aa, Homo sapiens
  Payload ID: 14575
  Gene Symbol: RHOBTB3
  Gene Name: Rho-related BTB domain containing 3
  ENSP ID: ENSP00000426390
  MOD_RES (1)..(1): Any amino acid
XEMYQVSRLQHICELFIITQLQSMPSRELASMNLDIVDLLKKAKFHHSDCLSTWLLHFIATNYLIFSQKPEFQDLSVEERSFVEKHRWPSNMYLKQLAEYRKYIHSRKCRCLVIKRH

SEQ ID NO: 73670 - protein, 104 aa, Homo sapiens
  Payload ID: 14575
  Gene Symbol: RHOBTB3
  Gene Name: Rho-related BTB domain containing 3
  ENSP ID: ENSP00000426479
MSIHIVALGNEGDTFHQDNRPSGLIRTYLGRSPLVSGDESSLLLNAASTVARPVFTEYQASAFGNVKLVVHDCPVWVRKSSCSALRLKKLFFPFFSPSPFCPLP

SEQ ID NO: 73671 - protein, 513 aa, Homo sapiens
  Payload ID: 14576
  Gene Symbol: RTKN
  Gene Name: rhotekin
  Uniprot ID: Q9BST9
  ENSP ID: ENSP00000233330
MREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 73672 - protein, 563 aa, Homo sapiens
  Payload ID: 14576
  Gene Symbol: RTKN
  Gene Name: rhotekin
  Uniprot ID: Q9BST9
  ENSP ID: ENSP00000272430
MFSRNHRSRVTVARGSALEMEFKRGRFRLSLFSDLPEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 73673 - protein, 550 aa, Homo sapiens
  Payload ID: 14576
  Gene Symbol: RTKN
  Gene Name: rhotekin
  Uniprot ID: Q9BST9
  ENSP ID: ENSP00000305298
MQDRLHILEDLNMLYIRQMALSLEDTELQRKLDHEIRMREGACKLLAACSQREQALEATKSLLVCNSRILSYMGELQRRKEAQVLGKTSRRPSDSGPPAERSPCRGRVCISDLRIPLMWKDTEYFKNKGDLHRWAVFLLLQLGEHIQDTEMILVDRTLTDISFQSNVLFAEAGPDFELRLELYGACVEEEGALTGGPKRLATKLSSSLGRSSGRRVRASLDSAGGSGSSPILLPTPVVGGPRYHLLAHTTLTLAAVQDGFRTHDLTLASHEENPAWLPLYGSVCCRLAAQPLCMTQPTASGTLRVQQAGEMQNWAQVHGVLKGTNLFCYRQPEDADTGEEPLLTIAVNKETRVRAGELDQALGRPFTLSISNQYGDDEVTHTLQTESREALQSWMEALWQLFFDMSQWKQCCDEIMKIETPAPRKPPQALAKQGSLYHEMAIEPLDDIAAVTDILTQREGARLETPPPWLAMFTDQPALPNPCSPASVAPAPDWTHPLPWGRPRTFSLDAVPPDHSPRARSVAPLPPQRSPRTRGLCSKGQPRTWLQSPV

SEQ ID NO: 73674 - protein, 308 aa, Homo sapiens
  Payload ID: 14577
  Gene Symbol: RTKN2
  Gene Name: rhotekin 2
  ENSP ID: ENSP00000325379
MCLLLSSAVFGVKYNLLAHTTLTLESAEDSFKTHNLSINGNEESSFWLPLYGNMCCRLVAQPACMAEDAFAGFLNQQQMVEGLISWRRLYCVLRGGKLYCFYSPEEIEAKVEPALVVPINKSLVLFEDSLEGIQLAISQSFKETRIRAMDKDAKKRIHNFSVINPVPGQAITQIFAVDNREDLQKWMEAFWQHFFDLSQWKHCCEELMKIEIMSPRKPPLFLTKEATSVYHDMSIDSPMKLESLTDIIQKKIEETNGQFLIGQHEESLPPPWATLFDGNHQMVIQKKNNSNQLHNLQKLPATSKFLFT

SEQ ID NO: 73675 - protein, 609 aa, Homo sapiens
  Payload ID: 14577
  Gene Symbol: RTKN2
  Gene Name: rhotekin 2
  Uniprot ID: Q8IZC4
  ENSP ID: ENSP00000362894
MEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIFNEAGPDFQIKVEVYSCCTEESSITNTPKKLAKKLKTSISKATGKKISSVLQEEDDEMCLLLSSAVFGVKYNLLAHTTLTLESAEDSFKTHNLSINGNEESSFWLPLYGNMCCRLVAQPACMAEDAFAGFLNQQQMVEGLISWRRLYCVLRGGKLYCFYSPEEIEAKVEPALVVPINKETRIRAMDKDAKKRIHNFSVINPVPGQAITQIFAVDNREDLQKWMEAFWQHFFDLSQWKHCCEELMKIEIMSPRKPPLFLTKEATSVYHDMSIDSPMKLESLTDIIQKKIEETNGQFLIGQHEESLPPPWATLFDGNHQMVIQKKVLYPASEPLHDEKGKKRQAPLPPSDKLPFSLKSQSNTDQLVKDNWGKTSVSQTSSLDTKLSTLMHHLQKPMAAPRKLLPARRNRLSDGEHTDTKTNFEAKPVPAPRQKSIKDILDPRSWLQAQV

SEQ ID NO: 73676 - protein, 163 aa, Homo sapiens
  Payload ID: 14577
  Gene Symbol: RTKN2
  Gene Name: rhotekin 2
  Uniprot ID: Q8IZC4
  ENSP ID: ENSP00000378678
MEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIL

SEQ ID NO: 73677 - protein, 184 aa, Homo sapiens
  Payload ID: 14578
  Gene Symbol: RHOXF1
  Gene Name: Rhox homeobox family, member 1
  Uniprot ID: Q8NHV9
  ENSP ID: ENSP00000217999
MARSLVHDTVFYCLSVYQVKISPTPQLGAASSAEGHVGQGAPGLMGNMNPEGGVNHENGMNRDGGMIPEGGGGNQEPRQQPQPPPEEPAQAAMEGPQPENMQPRTRRTKFTLLQVEELESVFRHTQYPDVPTRRELAENLGVTEDKVRVWFKNKRARCRRHQRELMLANELRADPDDCVYIVVD

SEQ ID NO: 73678 - protein, 288 aa, Homo sapiens
  Payload ID: 14579
  Gene Symbol: RHOXF2
  Gene Name: Rhox homeobox family, member 2
  Uniprot ID: Q9BQY4
  ENSP ID: ENSP00000360441
MEPPDQCSQYMTSLLSPAVDDEKELQDMNAMVLSLTEEVKEEEEDAQPEPEQGTAAGEKLKSAGAQGGEEKDGGGEEKDGGGAGVPGHLWEGDLEGTSGSDGNVEDSDQSEKEPGQQYSRPQGAVGGLEPGNAQQPNVHAFTPLQLQELERIFQREQFPSEFLRRRLARSMNVTELAVQIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 73679 - protein, 288 aa, Homo sapiens
  Payload ID: 14580
  Gene Symbol: RHOXF2B
  Gene Name: Rhox homeobox family, member 2B
  Uniprot ID: P0C7M4
  ENSP ID: ENSP00000360455
MEPPDQCSQYMTSLLSPAVDDEKELQDMNAMVLSLTEEVKEEEEDAQPEPEQGTAAGEKLKSAGAQGGEEKDGGGEEKDGGGAGVPGHLWEGNLEGTSGSDGNVEDSDQSEKEPGQQYSRPQGAVGGLEPGNAQQPNVHAFTPLQLQELECIFQREQFPSEFLRRRLARSMNVTELAVQIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 73680 - protein, 181 aa, Homo sapiens
  Payload ID: 14581
  Gene Symbol: RIBC1
  Gene Name: RIB43A domain with coiled-coils 1
  ENSP ID: ENSP00000332142
MYNIKQSTDTKEAAAIEARRNREKERQNRFFNVRNRVMGVDVQALNNQVGDRKRREAAERSKEAAYGTSQVQYDVVVQMLEKEEADRTRQLAKKVQEFREQKQQLKNGREFSLWDPGQVWKGLPTYLSYSNTYPGPASLQYFSGEDLDRDTRLRMQQGQFRYNLERQQQEQQQAKVDENYT

SEQ ID NO: 73681 - protein, 379 aa, Homo sapiens
  Payload ID: 14581
  Gene Symbol: RIBC1
  Gene Name: RIB43A domain with coiled-coils 1
  Uniprot ID: Q8N443
  ENSP ID: ENSP00000364476
MYNIKQSTDTKEAAAIEARRNREKERQNRFFNVRNRVMGVDVQALNNQVGDRKRREAAERSKEAAYGTSQVQYDVVVQMLEKEEADRTRQLAKKVQEFREQKQQLKNGREFSLWDPGQVWKGLPTYLSYSNTYPGPASLQYFSGEDLDRDTRLRMQQGQFRYNLERQQQEQQQAKVDENYTDALSNQLRLAMDAQATHLARLEESCRAAMMCAMANANKAQAAVQAGRQRCERQREQKANLAEIQHQSTSDLLTENPQVAQHPMAPYRVLPYCWKGMTPEQQAAIRKEQEVQRSKKQAHRQAEKTLDTEWKSQTMSSAQAVLELEEQERELCAVFQRGLGSFNQQLANEQKAQQDYLNSVIYTNQPTAQYHQQFNTSSR

SEQ ID NO: 73682 - protein, 238 aa, Homo sapiens
  Payload ID: 14581
  Gene Symbol: RIBC1
  Gene Name: RIB43A domain with coiled-coils 1
  Uniprot ID: Q8N443
  ENSP ID: ENSP00000401463
MYNIKQSTDTKEAAAIEARRNREKERQNRFFNVRNRVMGVDVQALNNQVGDRKRREAAERSKEAAYDALSNQLRLAMDAQATHLARLEESCRAAMMCAMANANKAQAAVQAGRQRCERQREQKANLAEIQHQSTSDLLTENPQVAQHPMAPYRVLPYCWKGMTPEQQAAIRKEQEVQRSKKQAHRQAEKTLDTEWKSQTMSSAQAVLELEEQERELCAVFQRGLGSFNQQLANEQKAQ

SEQ ID NO: 73683 - protein, 192 aa, Homo sapiens
  Payload ID: 14581
  Gene Symbol: RIBC1
  Gene Name: RIB43A domain with coiled-coils 1
  Uniprot ID: Q8N443
  ENSP ID: ENSP00000402080
MYNIKQSTDTKEAAAIEARRNREKERQNRFFNVRNRVMGVDVQALNNQVGDRKRREAAERSKEAAYGTSQVQYDVVVQMLEKEEADRTRQLAKKVQEFREQKQQLKNGREFSLWDPGQVWKGLPTYLSYSNTYPGPASLQYFSGEDLDRDTRLRMQQGQFRYNLERQQQEQQQAKVDENYTGKQPGPPDSET

SEQ ID NO: 73684 - protein, 382 aa, Homo sapiens
  Payload ID: 14582
  Gene Symbol: RIBC2
  Gene Name: RIB43A domain with coiled-coils 2
  ENSP ID: ENSP00000483356
MGSQTMAVALPRDLRQDANLAKRRHAELCRQKRVFNARNRIIGGDTEAWDVQVHDQKIKEATEKARHETFAAEMRQNDKIMCILENRKKRDRKNLCRAINDFQQSFQKPETRREFDLSDPLALKKDLPARQSDNDVRNTISGMQKFMGEDLNFHERKKFQEEQNREWSLQQQREWKNARAEQKCAEALYTETRLQFDETAKHLQKLESTTRKAVCASVKDFNKSQAIESVERKKQEKKQEQEDNLAEITNLLRGDLLSENPQQAASSFGPHRVVPDRWKGMTQEQLEQIRLVQKQQIQEKLRLQEEKRQRDLDWDRRRIQGARATLLFERQQWRRQRDLRRALDSSNLSLAKEQHLQKKYMNEVYTNQPTGDYFTQFNTGSR

SEQ ID NO: 73685 - protein, 155 aa, Homo sapiens
  Payload ID: 14583
  Gene Symbol: RFK
  Gene Name: riboflavin kinase
  Uniprot ID: Q969G6
  ENSP ID: ENSP00000365926
MRHLPYFCRGQVVRGFGRGSKQLGIPTANFPEQVVDNLPADISTGIYYGWASVGSGDVHKMVVSIGWNPYYKNTKKSMETHIMHTFKEDFYGEILNVAIVGYLRPEKNFDSLESLISAIQGDIEEAKKRLELPEHLKIKEDNFFQVSKSKIMNGH

SEQ ID NO: 73686 - protein, 120 aa, Homo sapiens
  Payload ID: 14583
  Gene Symbol: RFK
  Gene Name: riboflavin kinase
  ENSP ID: ENSP00000417215
RGFGRGSKQLGIPTANFPEQVVDNLPADISTGIYYGWASVGSGDVHKMVVSIGWNPYYKNTKKSMETHIMHTFKEDFYGEILNVAIVGYLRPEKNFDSLAGWLLLSSGMKLMKSFKMCEV

SEQ ID NO: 73687 - protein, 322 aa, Homo sapiens [sequence omitted]

SEQ ID NO: 73688 - protein, 147 aa, Homo sapiens
  Payload ID: 14584
  Gene Symbol: RBKS
  Gene Name: ribokinase
  ENSP ID: ENSP00000393558
  MOD_RES (1)..(1): Any amino acid
XNVISRAKVMVCQLEITPATSLEALTMARRSGVKTLFNPAPAIADLDPQFYTLSDVFCCNESEAEILTGLTVGSAADAGEAALVLLKRGCQVVIITLGAEGCVVLSQTEPEPKHIPTEKVKAVDTTCRPGSRPKSEAASVKKQKHYK

SEQ ID NO: 73689 - protein, 63 aa, Homo sapiens
  Payload ID: 14584
  Gene Symbol: RBKS
  Gene Name: ribokinase
  ENSP ID: ENSP00000413789
MAASGEPQRQWQEEVAAVVVVGSCMTDLVRRMCMRICYVHFCCQPTPQLQNCSSLCVITCQEN

SEQ ID NO: 73690 - protein, 36 aa, Homo sapiens
  Payload ID: 14584
  Gene Symbol: RBKS
  Gene Name: ribokinase
  ENSP ID: ENSP00000415975
MAASGEPQRQWQEEVAAVVVVGSCMTDLVRRYIRTQ

SEQ ID NO: 73691 - protein, 18 aa, Homo sapiens
  Payload ID: 14584
  Gene Symbol: RBKS
  Gene Name: ribokinase
  ENSP ID: ENSP00000483033
VLSLYLFCKSKTKKNVLV

SEQ ID NO: 73692 - protein, 286 aa, Homo sapiens
  Payload ID: 14585
  Gene Symbol: RNASEH1
  Gene Name: ribonuclease H1
  Uniprot ID: O60930
  ENSP ID: ENSP00000313350
MSWLLFLAHRVALAALPCRRGSRGFGMFYAVRRGRKTGVFLTWNECRAQVDRFPAARFKKFATEDEAWAFVRKSASPEVSEGHENQHGQESEAKASKRLREPLDGDGHESAEPYAKHMKPSVEPAPPVSRDTFSYMGDFVVVYTDGCCSSNGRRRPRAGIGVYWGPGHPLNVGIRLPGRQTNQRAEIHAACKAIEQAKTQNINKLVLYTDSMFTINGITNWVQGWKKNGWKTSAGKEVINKEDFVALERLTQGMDIQWMHVPGHSGFIGNEEADRLAREGAKQSED

SEQ ID NO: 73693 - protein, 43 aa, Homo sapiens
  Payload ID: 14585
  Gene Symbol: RNASEH1
  Gene Name: ribonuclease H1
  ENSP ID: ENSP00000404926
MSWLLFLAHRVALAALPCRRGSRGFGMFYAVRRGRKTGVFLTW

SEQ ID NO: 73694 - protein, 43 aa, Homo sapiens
  Payload ID: 14585
  Gene Symbol: RNASEH1
  Gene Name: ribonuclease H1
  ENSP ID: ENSP00000411646
MSWLLFLAHRVALAALPCRRGSRGFGMFYAVRRGRKTGVFLTC

SEQ ID NO: 73695 - protein, 299 aa, Homo sapiens
  Payload ID: 14586
  Gene Symbol: RNASEH2A
  Gene Name: ribonuclease H2, subunit A
  Uniprot ID: O75792
  ENSP ID: ENSP00000221486
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQARLQQSFPGIEVTVKAKADALYPVVSAASICAKVARDQAVKKWQFVEKLQDLDTDYGSGYPNDPKTKAWLKEHVEPVFGFPQFVRFSWRTAQTILEKEAEDVIWEDSASENQEGLRKITSYFLNEGSQARPRSSHRYFLERGLESATSL

SEQ ID NO: 73696 - protein, 312 aa, Homo sapiens
  Payload ID: 14587
  Gene Symbol: RNASEH2B
  Gene Name: ribonuclease H2, subunit B
  Uniprot ID: Q5TBB1
  ENSP ID: ENSP00000337623
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKKNSKMTAAQKALAKVDKSGMKSIDTFFGVKNKKKIGKV

SEQ ID NO: 73697 - protein, 257 aa, Homo sapiens
  Payload ID: 14587
  Gene Symbol: RNASEH2B
  Gene Name: ribonuclease H2, subunit B
  Uniprot ID: Q5TBB1
  ENSP ID: ENSP00000389877
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKMAAQRQKRGK

SEQ ID NO: 73698 - protein, 332 aa, Homo sapiens
  Payload ID: 14587
  Gene Symbol: RNASEH2B
  Gene Name: ribonuclease H2, subunit B
  ENSP ID: ENSP00000481236
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKKNSKMTAAQKALAKVDKSGMKSIDTFFGVKNKKLERFETLKIKSSKNICFLHVSVCPS

SEQ ID NO: 73699 - protein, 84 aa, Homo sapiens
  Payload ID: 14587
  Gene Symbol: RNASEH2B
  Gene Name: ribonuclease H2, subunit B
  ENSP ID: ENSP00000482701
  MOD_RES (1)..(1): Any amino acid
XDYIRYAHGLISDYIPKELSDDLSKYLKLPEPSASLPNPPSKKIKLSDEPVEAKEDYTKFNTKDLKTEKVCGFRCSGVSFILSA

SEQ ID NO: 73700 - protein, 164 aa, Homo sapiens
  Payload ID: 14588
  Gene Symbol: RNASEH2C
  Gene Name: ribonuclease H2, subunit C
  Uniprot ID: Q8TDP1
  ENSP ID: ENSP00000308193
MESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 73701 - protein, 81 aa, Homo sapiens
  Payload ID: 14588
  Gene Symbol: RNASEH2C
  Gene Name: ribonuclease H2, subunit C
  ENSP ID: ENSP00000431555
MVTEEKKVSMGKPDPLRDSGTDDQEEEPLERDFDRFIGATANFSRFTLWGLETIPGPDAKVRGALTWPSLAAAIHAQVPED

SEQ ID NO: 73702 - protein, 129 aa, Homo sapiens
  Payload ID: 14588
  Gene Symbol: RNASEH2C
  Gene Name: ribonuclease H2, subunit C
  ENSP ID: ENSP00000432081
  MOD_RES (1)..(1): Any amino acid
XRAAPGSTQRGSCLRPFAPPAPGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 73703 - protein, 247 aa, Homo sapiens
  Payload ID: 14588
  Gene Symbol: RNASEH2C
  Gene Name: ribonuclease H2, subunit C
  ENSP ID: ENSP00000432897
MESGDEAAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAVSRRGVPSCPRVDGLGSTIAQTEPGGFYWVVCGKRSSLTTLPSMSRSGYSEQLGPSSGMGASLPPCLTSPTVEATPVADSRTGARGLRTRA

SEQ ID NO: 73704 - protein, 124 aa, Homo sapiens
  Payload ID: 14588
  Gene Symbol: RNASEH2C
  Gene Name: ribonuclease H2, subunit C
  ENSP ID: ENSP00000434996
  MOD_RES (1)..(1): Any amino acid
XSTQRGSCLRPFAPPAPGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 73705 - protein, 158 aa, Homo sapiens
  Payload ID: 14588
  Gene Symbol: RNASEH2C
  Gene Name: ribonuclease H2, subunit C
  ENSP ID: ENSP00000435717
  MOD_RES (1)..(1): Any amino acid
XAIERHRVHLRSATLRDAVPATLHLLPCEVAVDGPAPVGRFFTPAIRQGPEGLEVSFRGRCLRGEEVAVPPGLVGYVMVTEEKKVSMGKPDPLRDSGTDDQEEEPLERDFDRFIGATANFSRFTLWGLETIPGPDAKVRGALTWPSLAAAIHAQVPED

SEQ ID NO: 73706 - protein, 741 aa, Homo sapiens
  Payload ID: 14589
  Gene Symbol: RNASEL
  Gene Name: ribonuclease L (2',5'-oligoisoadenylate synthetase-dependent)
  Uniprot ID: Q05823
  ENSP ID: ENSP00000356530
MESRDHNNPQEGPTSSSGRRAAVEDNHLLIKAVQNEDVDLVQQLLEGGANVNFQEEEGGWTPLHNAVQMSREDIVELLLRHGADPVLRKKNGATPFILAAIAGSVKLLKLFLSKGADVNECDFYGFTAFMEAAVYGKVKALKFLYKRGANVNLRRKTKEDQERLRKGGATALMDAAEKGHVEVLKILLDEMGADVNACDNMGRNALIHALLSSDDSDVEAITHLLLDHGADVNVRGERGKTPLILAVEKKHLGLVQRLLEQEHIEINDTDSDGKTALLLAVELKLKKIAELLCKRGASTDCGDLVMTARRNYDHSLVKVLLSHGAKEDFHPPAEDWKPQSSHWGAALKDLHRIYRPMIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIDSKKAAHLADFDKSIKWAGDPQEVKRDLEDLGRLVLYVVKKGSISFEDLKAQSNEEVVQLSPDEETKDLIHRLFHPGEHVRDCLSDLLGHPFFWTWESRYRTLRNVGNESDIKTRKSESEILRLLQPGPSEHSKSFDKWTTKINECVMKKMNKFYEKRGNFYQNTVGDLLKFIRNLGEHIDEEKHKKMKLKIGDPSLYFQKTFPDLVIYVYTKLQNTEYRKHFPQTHSPNKPQCDGAGGASGLASPGC

SEQ ID NO: 73707 - protein, 652 aa, Homo sapiens
  Payload ID: 14589
  Gene Symbol: RNASEL
  Gene Name: ribonuclease L (2',5'-oligoisoadenylate synthetase-dependent)
  Uniprot ID: Q05823
  ENSP ID: ENSP00000440844
MESRDHNNPQEGPTSSSGRRAAVEDNHLLIKAVQNEDVDLVQQLLEGGANVNFQEEEGGWTPLHNAVQMSREDIVELLLRHGADPVLRKKNGATPFILAAIAGSVKLLKLFLSKGADVNECDFYGFTAFMEAAVYGKVKALKFLYKRGANVNLRRKTKEDQERLRKGGATALMDAAEKGHVEVLKILLDEMGADVNACDNMGRNALIHALLSSDDSDVEAITHLLLDHGADVNVRGERGKTPLILAVEKKHLGLVQRLLEQEHIEINDTDSDGKTALLLAVELKLKKIAELLCKRGASTDCGDLVMTARRNYDHSLVKVLLSHGAKEDFHPPAEDWKPQSSHWGAALKDLHRIYRPMIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIDSKKAAHLADFDKSIKWAGDPQEVKRDLEDLGRLVLYVVKKGSISFEDLKAQSNEEVVQLSPDEETKDLIHRLFHPGEHVRDCLSDLLGHPFFWTWESRYRTLRNVGNESDIKTRKSESEILRLLQPGPSEHSKSFDKWTTKMSKLRHRQIIFPTTQNQ

SEQ ID NO: 73708 - protein, 124 aa, Homo sapiens
  Payload ID: 14590
  Gene Symbol: RPP14
  Gene Name: ribonuclease P/MRP 14kDa subunit
  Uniprot ID: O95059
  ENSP ID: ENSP00000295959
MPAPAATYERVVYKNPSEYHYMKVCLEFQDCGVGLNAAQFKQLLISAVKDLFGEVDAALPLDILTYEEKTLSAILRICSSGLVKLWSSLTLLGSYKGKKCAFRVIQVSPFLLALSGNSRELVLD

SEQ ID NO: 73709 - protein, 124 aa, Homo sapiens; identical to SEQ ID NO: 73708
  Payload ID: 14590
  Gene Symbol: RPP14
  Gene Name: ribonuclease P/MRP 14kDa subunit
  Uniprot ID: O95059
  ENSP ID: ENSP00000412894

SEQ ID NO: 73710 - protein, 124 aa, Homo sapiens; identical to SEQ ID NO: 73708
  Payload ID: 14590
  Gene Symbol: RPP14
  Gene Name: ribonuclease P/MRP 14kDa subunit
  Uniprot ID: O95059
  ENSP ID: ENSP00000419909

SEQ ID NO: 73711 - protein, 154 aa, Homo sapiens
  Payload ID: 14591
  Gene Symbol: RPP21
  Gene Name: ribonuclease P/MRP 21kDa subunit
  Uniprot ID: Q9H633
  ENSP ID: ENSP00000365829
MAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 73712 - protein, 177 aa, Homo sapiens
  Payload ID: 14591
  Gene Symbol: RPP21
  Gene Name: ribonuclease P/MRP 21kDa subunit
  ENSP ID: ENSP00000388494
MAGPVKDREAFQRLNFLYQVSLRQGPHGDGARRPRVTAPLPQAAHCVLAQDPENQALARFYCYTERTIAKRLVLRRDPSVKRTLCRGCSSLLVPGLTCTHRQRRCRGQRWTVQTCLTCQRSQRFLNDPGHLLWGDRPEAQLGSQADSKPLQPLPNTAHSISDRLPEEKMQTQGSSNQ

SEQ ID NO: 73713 - protein, 177 aa, Homo sapiens; identical to SEQ ID NO: 73712
  Payload ID: 14591
  Gene Symbol: RPP21
  Gene Name: ribonuclease P/MRP 21kDa subunit
  ENSP ID: ENSP00000389565

SEQ ID NO: 73714 - protein, 177 aa, Homo sapiens; identical to SEQ ID NO: 73712
  Payload ID: 14591
  Gene Symbol: RPP21
  Gene Name: ribonuclease P/MRP 21kDa subunit
  ENSP ID: ENSP00000391247

SEQ ID NO: 73715 - protein, 177 aa, Homo sapiens
  Payload ID: 14591
  Gene Symbol: RPP21
  Gene Name: ribonuclease P/MRP 21kDa subunit
  Uniprot ID: Q9H633
  ENSP ID: ENSP00000394320
MAGPVKDREAFQRLNFLYQVSLRQGPHGDGARRPRVTAPLPQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 73716 - protein, 144 aa, Homo sapiens
  Payload ID: 14591
  Gene Symbol: RPP21
  Gene Name: ribonuclease P/MRP 21kDa subunit
  Uniprot ID: Q9H633
  ENSP ID: ENSP00000397778
MAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQAGERFQTTTTLAKHSPLHFRPPS

SEQ ID NO: 73717 - protein, 154 aa, Homo sapiens [sequence omitted]

SEQ ID NO: 73718 - protein, 154 aa, Homo sapiens; identical to SEQ ID NO: 73711
  Payload ID: 14591
  Gene Symbol: RPP21
  Gene Name: ribonuclease P/MRP 21kDa subunit
  Uniprot ID: Q9H633
  ENSP ID: ENSP00000399295

SEQ ID NO: 73719 - protein, 162 aa, Homo sapiens
  Payload ID: 14591
  Gene Symbol: RPP21
  Gene Name: ribonuclease P/MRP 21kDa subunit
  ENSP ID: ENSP00000401788
MAGPVKDREAFQRLNFLYQAAHCVLAQDPENQALARFYCYTERTIAKRLVLRRPLSSSAPRDPSVKRTLCRGCSSLLVPGLTCTHRQRRCRGQRWTVQTCLTCQRSQRFLNDPGHLLWGDRPEAQLGSQADSKPLQPLPNTAHSISDRLPEEKMQTQGSSNQ

SEQ ID NO: 73720 - protein, 144 aa, Homo sapiens; identical to SEQ ID NO: 73716
  Payload ID: 14591
  Gene Symbol: RPP21
  Gene Name: ribonuclease P/MRP 21kDa subunit
  Uniprot ID: Q9H633
  ENSP ID: ENSP00000403747

SEQ ID NO: 73721 - protein, 154 aa, Homo sapiens; identical to SEQ ID NO: 73711
  Payload ID: 14591
  Gene Symbol: RPP21
  Gene Name: ribonuclease P/MRP 21kDa subunit
  Uniprot ID: Q9H633
  ENSP ID: ENSP00000403833

SEQ ID NO: 73722 - protein, 154 aa, Homo sapiens
  Payload ID: 14591
  Gene Symbol: RPP21
  Gene Name: ribonuclease P/MRP 21kDa subunit
  ENSP ID: ENSP00000404260
MAGPVKDREAFQRLNFLYQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTKGSSNQ

SEQ ID NO: 73723 - protein, 154 aa, Homo sapiens [sequence omitted]

SEQ ID NO: 73724 - protein, 177 aa, Homo sapiens
  Payload ID: 14591
  Gene Symbol: RPP21
  Gene Name: ribonuclease P/MRP 21kDa subunit
  ENSP ID: ENSP00000405035
MAGPVKDREAFQRLNFLYQVSLRQGPHGDGARRPRVTAPLPQAAHCVLAQDPENQALARFYCYTERTIAKRLVLRRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTKGSSNQ

SEQ ID NO: 73725 - protein, 144 aa, Homo sapiens
  Payload ID: 14591
  Gene Symbol: RPP21
  Gene Name: ribonuclease P/MRP 21kDa subunit
  ENSP ID: ENSP00000405448
MAGPVKDREAFQRLNFLYQAAHCVLAQDPENQALARFYCYTERTIAKRLVLRRDPSVKRTLCRGCSSLLVPGLTCTHRQRRCRGQRWTVQTCLTCQRSQRFLNDPGHLLWGDRPEAQLGSQAGERFQTTTTLAKHSPLHFRPPS

SEQ ID NO: 73726 - protein, 162 aa, Homo sapiens
  Payload ID: 14591
  Gene Symbol: RPP21
  Gene Name: ribonuclease P/MRP 21kDa subunit
  Uniprot ID: Q9H633
  ENSP ID: ENSP00000405834
MAGPVKDREAFQRLNFLYQAAHCVLAQDPENQALARFYCYTERTIAKRLVLRRPLSSSAPRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTQGSSNQ

SEQ ID NO: 73727 - protein, 162 aa, Homo sapiens; identical to SEQ ID NO: 73719
  Payload ID: 14591
  Gene Symbol: RPP21
  Gene Name: ribonuclease P/MRP 21kDa subunit
  ENSP ID: ENSP00000408577

SEQ ID NO: 73728 - protein, 144 aa, Homo sapiens; identical to SEQ ID NO: 73716
  Payload ID: 14591
  Gene Symbol: RPP21
  Gene Name: ribonuclease P/MRP 21kDa subunit
  Uniprot ID: Q9H633
  ENSP ID: ENSP00000408610

SEQ ID NO: 73729 - protein, 162 aa, Homo sapiens; identical to SEQ ID NO: 73726
  Payload ID: 14591
  Gene Symbol: RPP21
  Gene Name: ribonuclease P/MRP 21kDa subunit
  Uniprot ID: Q9H633
  ENSP ID: ENSP00000409193

SEQ ID NO: 73730 - protein, 162 aa, Homo sapiens; identical to SEQ ID NO: 73726
  Payload ID: 14591
  Gene Symbol: RPP21
  Gene Name: ribonuclease P/MRP 21kDa subunit
  Uniprot ID: Q9H633
  ENSP ID: ENSP00000409799

SEQ ID NO: 73731 - protein, 144 aa, Homo sapiens; identical to SEQ ID NO: 73725
  Payload ID: 14591
  Gene Symbol: RPP21
  Gene Name: ribonuclease P/MRP 21kDa subunit
  ENSP ID: ENSP00000410328

SEQ ID NO: 73732 - protein, 144 aa, Homo sapiens; identical to SEQ ID NO: 73716
  Payload ID: 14591
  Gene Symbol: RPP21
  Gene Name: ribonuclease P/MRP 21kDa subunit
  Uniprot ID: Q9H633
  ENSP ID: ENSP00000411003

SEQ ID NO: 73733 - protein, 162 aa, Homo sapiens
  Payload ID: 14591
  Gene Symbol: RPP21
  Gene Name: ribonuclease P/MRP 21kDa subunit
  ENSP ID: ENSP00000412056
MAGPVKDREAFQRLNFLYQAAHCVLAQDPENQALARFYCYTERTIAKRLVLRRPLSSSAPRDPSVKRTLCRGCSSLLVPGLTCTQRQRRCRGQRWTVQTCLTCQRSQRFLNDPGHLLWGDRPEAQLGSQADSKPLQPLPNTAHSISDRLPEEKMQTKGSSNQ

SEQ ID NO: 73734 - protein, 144 aa, Homo sapiens; identical to SEQ ID NO: 73725
  Payload ID: 14591
  Gene Symbol: RPP21
  Gene Name: ribonuclease P/MRP 21kDa subunit
  ENSP ID: ENSP00000412174

SEQ ID NO: 73735 - protein, 177 aa, Homo sapiens; identical to SEQ ID NO: 73715
  Payload ID: 14591
  Gene Symbol: RPP21
  Gene Name: ribonuclease P/MRP 21kDa subunit
  Uniprot ID: Q9H633
  ENSP ID: ENSP00000412619

SEQ ID NO: 73736 - protein, 154 aa, Homo sapiens [sequence omitted]

SEQ ID NO: 73737 - protein, 177 aa, Homo sapiens; identical to SEQ ID NO: 73715
  Payload ID: 14591
  Gene Symbol: RPP21
  Gene Name: ribonuclease P/MRP 21kDa subunit
  Uniprot ID: Q9H633
  ENSP ID: ENSP00000415046

SEQ ID NO: 73738 - protein, 162 aa, Homo sapiens; identical to SEQ ID NO: 73719
  Payload ID: 14591
  Gene Symbol: RPP21
  Gene Name: ribonuclease P/MRP 21kDa subunit
  ENSP ID: ENSP00000416194

SEQ ID NO: 73739 - protein, 199 aa, Homo sapiens
  Payload ID: 14592
  Gene Symbol: RPP25
  Gene Name: ribonuclease P/MRP 25kDa subunit
  Uniprot ID: Q9BUL9
  ENSP ID: ENSP00000317691
MENFRKVRSEEAPAGCGAEGGGPGSGPFADLAPGAVHMRVKEGSKIRNLMAFATASMAQPATRAIVFSGCGRATTKTVTCAEILKRRLAGLHQVTRLRYRSVREVWQSLPPGPTQGQTPGEPAASLSVLKNVPGLAILLSKDALDPRQPGYQPPNPHPGPSSPPAAPASKRSLGEPAAGEGSAKRSQPEPGVADEDQTA

SEQ ID NO: 73740 - protein, 163 aa, Homo sapiens
  Payload ID: 14593
  Gene Symbol: RPP25L
  Gene Name: ribonuclease P/MRP 25kDa subunit-like
  Uniprot ID: Q8N5L8
  ENSP ID: ENSP00000297613
MEHYRKAGSVELPAPSPMPQLPPDTLEMRVRDGSKIRNLLGLALGRLEGGSARHVVFSGSGRAAGKAVSCAEIVKRRVPGLHQLTKLRFLQTEDSWVPASPDTGLDPLTVRRHVPAVWVLLSRDPLDPNECGYQPPGAPPGLGSMPSSSCGPRSRRRARDTRS

SEQ ID NO: 73741 - protein, 163 aa, Homo sapiens; identical to SEQ ID NO: 73740
  Payload ID: 14593
  Gene Symbol: RPP25L
  Gene Name: ribonuclease P/MRP 25kDa subunit-like
  Uniprot ID: Q8N5L8
  ENSP ID: ENSP00000368242

SEQ ID NO: 73742 - protein, 254 aa, Homo sapiens
  Payload ID: 14594
  Gene Symbol: RPP30
  Gene Name: ribonuclease P/MRP 30kDa subunit
  ENSP ID: ENSP00000277882
MAVFADLDLRAGSDLKALRGLVETAAHRELPRLRAWPTSCHPDHRATLRIGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHG

SEQ ID NO: 73743 - protein, 268 aa, Homo sapiens
  Payload ID: 14594
  Gene Symbol: RPP30
  Gene Name: ribonuclease P/MRP 30kDa subunit
  Uniprot ID: P78346
  ENSP ID: ENSP00000360768
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAKCEG

SEQ ID NO: 73744 - protein, 322 aa, Homo sapiens
  Payload ID: 14594
  Gene Symbol: RPP30
  Gene Name: ribonuclease P/MRP 30kDa subunit
  Uniprot ID: P78346
  ENSP ID: ENSP00000389182
MAVFADLDLRAGSDLKALRGLVETAAHLGYSVVAINHIVDFKEKKQEIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKNVIISSAAERPLEIRGPYDVANLGLLFGLSESDAKAAVSTNCRAALLHGETRKTAFGIISTVKKPRPSEGDEDCLPASKKAKWSHSVTQAGVQWHNLGSLQPLPLGLKPSSHLSLPRTRIQQRQLLISHQRDHTPKNRL

SEQ ID NO: 73745 - protein, 212 aa, Homo sapiens
  Payload ID: 14594
  Gene Symbol: RPP30
  Gene Name: ribonuclease P/MRP 30kDa subunit
  ENSP ID: ENSP00000407972
EIEKPVAVSELFTTLPIVQGKSRPIKILTRLTIIVSDPSHCNVLRATSSRARLYDVVAVFPKTEKLFHIACTHLDVDLVCITVTEKLPFYFKRPPINVAIDRGLAFELVYSPAIKDSTMRRYTISSALNLMQICKGKPLEIRGPYDVANLGLLFGLSESDAKAAVSTNCRAALLHGETRKTAFGIISTVKKPRPSEGDEDCLPASKKAKCEG

SEQ ID NO: 73746 - protein, 283 aa, Homo sapiens
  Payload ID: 14595
  Gene Symbol: RPP38
  Gene Name: ribonuclease P/MRP 38kDa subunit
  Uniprot ID: P78345
  ENSP ID: ENSP00000367439
MAAAPQAPGRGSLRKTRPLVVKTSLNNPYIIRWSALESEDMHFILQTLEDRLKAIGLQKIEDKKKKNKTPFLKKESREKCSIAVDISENLKEKKTDAKQQVSGWTPAHVRKQLAIGVNEVTRALERRELLLVLVCKSVKPAMITSHLIQLSLSRSVPACQVPRLSERIAPVIGLKCVLALAFKKNTTDFVDEVRAIIPRVPSLSVPWLQDRIEDSGENLETEPLESQDRELLDTSFEDLSKPKRKLADGRQASVTLQPLKIKKLIPNPNKIRKPPKSKKATPK

SEQ ID NO: 73747 - protein, 145 aa, Homo sapiens
  Payload ID: 14595
  Gene Symbol: RPP38
  Gene Name: ribonuclease P/MRP 38kDa subunit
  ENSP ID: ENSP00000367443
MAAAPQAPGRGSLRKTRPLVVKTSLNNPYIIRWSALESEDMHFILQTLEDRLKAIGLQKIEDKKKKNKTPFLKKESREKCSIAVDISENLKEKKTDAKQQVSGWTPAHVRKQLAIGVNEVTRALERRELLLVLFHSCCPGWSAVV

SEQ ID NO: 73748 - protein, 283 aa, Homo sapiens; identical to SEQ ID NO: 73746
  Payload ID: 14595
  Gene Symbol: RPP38
  Gene Name: ribonuclease P/MRP 38kDa subunit
  Uniprot ID: P78345
  ENSP ID: ENSP00000367444

SEQ ID NO: 73749 - protein, 283 aa, Homo sapiens; identical to SEQ ID NO: 73746
  Payload ID: 14595
  Gene Symbol: RPP38
  Gene Name: ribonuclease P/MRP 38kDa subunit
  Uniprot ID: P78345
  ENSP ID: ENSP00000367445

SEQ ID NO: 73750 - protein, 168 aa, Homo sapiens
  Payload ID: 14595
  Gene Symbol: RPP38
  Gene Name: ribonuclease P/MRP 38kDa subunit
  ENSP ID: ENSP00000402635
MAAAPQAPGRGSLRKTRPLVVKTSLNNPYIIRWSALESEDMHFILQTLEDRLKAIGLQKIEDKKKKNKTPFLKKESREKCSIAVDISENLKEKKTDAKQQVSGWTPAHVRKQLAIGVNEVTRALERRELLLVLVCKSVKPAMITSHLIQLSLSRSVPACQVPRLSERI

SEQ ID NO: 73751 - protein, 283 aa, Homo sapiens; identical to SEQ ID NO: 73746
  Payload ID: 14595
  Gene Symbol: RPP38
  Gene Name: ribonuclease P/MRP 38kDa subunit
  Uniprot ID: P78345
  ENSP ID: ENSP00000478982

SEQ ID NO: 73752 - protein, 340 aa, Homo sapiens
  Payload ID: 14596
  Gene Symbol: RPP40
  Gene Name: ribonuclease P/MRP 40kDa subunit
  Uniprot ID: O75818
  ENSP ID: ENSP00000317998
MATLRRLREAPRHLLVCEKSNFGNHKSRHRHLVQTHYYNYRVSFLIPECGILSEELKNLVMNTGPYYFVKNLPLHELITPEFISTFIKKGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLCHYFDEPKLAPWVTLSVQGFADSPVSWEKNEHGFRKGGEHLYNFVIFNNQDYWLQMAVGANDHCPP

SEQ ID NO: 73753 - protein, 363 aa, Homo sapiens
  Payload ID: 14596
  Gene Symbol: RPP40
  Gene Name: ribonuclease P/MRP 40kDa subunit
  Uniprot ID: O75818
  ENSP ID: ENSP00000369391
MATLRRLREAPRHLLVCEKSNFGNHKSRHRHLVQTHYYNYRVSFLIPECGILSEELKNLVMNTGPYYFVKNLPLHELITPEFISTFIKKGSCYALTYNTHIDEDNTVALLPNGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLCHYFDEPKLAPWVTLSVQGFADSPVSWEKNEHGFRKGGEHLYNFVIFNNQDYWLQMAVGANDHCPP

SEQ ID NO: 73754 - protein, 113 aa, Homo sapiens
  Payload ID: 14596
  Gene Symbol: RPP40
  Gene Name: ribonuclease P/MRP 40kDa subunit
  ENSP ID: ENSP00000418874
MATLRRLREAPRHLLVCEKSNFGNHKSRHRHLVQTHYYNYRVSFLIPECGILSEELKNLVMNTGPYYFVKNLPLHELITPEFISTFIKKEFYFGPLSAHPQRFLLCTNIQYTY

SEQ ID NO: 73755 - protein, 303 aa, Homo sapiens
  Payload ID: 14596
  Gene Symbol: RPP40
  Gene Name: ribonuclease P/MRP 40kDa subunit
  ENSP ID: ENSP00000419431
MNTGPYYFVKNLPLHELITPEFISTFIKKGSCYALTYNTHIDEDNTVALLPNGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLCHYFDEPKLAPWVTLSVQGFADSPVSWEKNEHGFRKGGEHLYNFVIFNNQDYWLQMAVGANDHCPP

SEQ ID NO: 73756 - protein, 321 aa, Homo sapiens
  Payload ID: 14596
  Gene Symbol: RPP40
  Gene Name: ribonuclease P/MRP 40kDa subunit
  ENSP ID: ENSP00000484334
MATLRRLREAPRHLLVCEKSNFGNHKSRHRHLVQTHYYNYRVSFLIPECGILSEELKNLVMNTGPYYFVKNLPLHELITPEFISTFIKKGSCYALTYNTHIDEDNTVALLPNGKLILSLDKDTYEETGLQGHPSQFSGRKIMKFSSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLCHYFDEPKLAPWVTLSVQGFADSPVSWEKNEHGFRKGGEHLYNFVIFNNQDYWLQMAVGANDHCPP

SEQ ID NO: 73757 - protein, 71 aa, Homo sapiens
  Payload ID: 14597
  Gene Symbol: RNASET2
  Gene Name: ribonuclease T2
  ENSP ID: ENSP00000028008
MRPAALRGALLGCLCLALLCLGGADKRLRDNHEWKKLIMVQHWPETVCEKIQNDCRDPPDYWTIHGLWQAR

SEQ ID NO: 73758 - protein, 121 aa, Homo sapiens
  Payload ID: 14597
  Gene Symbol: RNASET2
  Gene Name: ribonuclease T2
  Uniprot ID: O00584
  ENSP ID: ENSP00000390833
MRPAALRGALLGCLCLALLCLGGADKRLRDNHEWKKLIMVQHWPETVCEKIQNDCRDPPDYWTIHGLWPDKSEGCNRSWPFNLEEIKKNWMEITDSSLPSPSTLPIINIFYSVLHLLQLMN

SEQ ID NO: 73759 - protein, 256 aa, Homo sapiens
  Payload ID: 14597
  Gene Symbol: RNASET2
  Gene Name: ribonuclease T2
  Uniprot ID: O00584
  ENSP ID: ENSP00000422846
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 73760 - protein, 218 aa, Homo sapiens
  Payload ID: 14597
  Gene Symbol: RNASET2
  Gene Name: ribonuclease T2
  ENSP ID: ENSP00000424947
MVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 73761 - protein, 253 aa, Homo sapiens
  Payload ID: 14597
  Gene Symbol: RNASET2
  Gene Name: ribonuclease T2
  ENSP ID: ENSP00000426059
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKK

SEQ ID NO: 73762 - protein, 256 aa, Homo sapiens; identical to SEQ ID NO: 73759
  Payload ID: 14597
  Gene Symbol: RNASET2
  Gene Name: ribonuclease T2
  Uniprot ID: O00584
  ENSP ID: ENSP00000426455

SEQ ID NO: 73763 - protein, 238 aa, Homo sapiens
  Payload ID: 14597
  Gene Symbol: RNASET2
  Gene Name: ribonuclease T2
  ENSP ID: ENSP00000480244
MRPAALRGALLGCLCLALLCLGGADKRLRDNHEWKKLIMVQHWPETVCEKIQNDCRDPPDYWTIHGLWPDKSEGCNRSWPFNLEEIKKNWMEITDSSLPSPSMGPAPPRWMRSTPRRSTLAEAWNSTGSWTSTGGCALPPAALPSGDLCCRPSLTAGSRGVGVDLTALQQLLHVHYSATGIIPEECSEPTKPFQIILHHDHTEWVQSIGMPIWTISSSESAIGKTRTQPACAVLSHDS

SEQ ID NO: 73764 - protein, 306 aa, Homo sapiens [sequence omitted]

SEQ ID NO: 73765 - protein, 156 aa, Homo sapiens
  Payload ID: 14598
  Gene Symbol: RNASE1
  Gene Name: ribonuclease, RNase A family, 1 (pancreatic)
  Uniprot ID: P07998
  ENSP ID: ENSP00000344193
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 73766 - protein, 156 aa, Homo sapiens; identical to SEQ ID NO: 73765
  Payload ID: 14598
  Gene Symbol: RNASE1
  Gene Name: ribonuclease, RNase A family, 1 (pancreatic)
  Uniprot ID: P07998
  ENSP ID: ENSP00000381057

SEQ ID NO: 73767 - protein, 156 aa, Homo sapiens; identical to SEQ ID NO: 73765
  Payload ID: 14598
  Gene Symbol: RNASE1
  Gene Name: ribonuclease, RNase A family, 1 (pancreatic)
  Uniprot ID: P07998
  ENSP ID: ENSP00000381060

SEQ ID NO: 73768 - protein, 156 aa, Homo sapiens; identical to SEQ ID NO: 73765
  Payload ID: 14598
  Gene Symbol: RNASE1
  Gene Name: ribonuclease, RNase A family, 1 (pancreatic)
  Uniprot ID: P07998
  ENSP ID: ENSP00000399493

SEQ ID NO: 73769 - protein, 116 aa, Homo sapiens
  Payload ID: 14598
  Gene Symbol: RNASE1
  Gene Name: ribonuclease, RNase A family, 1 (pancreatic)
  ENSP ID: ENSP00000451058
MDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 73770 - protein, 216 aa, Homo sapiens
  Payload ID: 14599
  Gene Symbol: RNASE10
  Gene Name: ribonuclease, RNase A family, 10 (non-active)
  Uniprot ID: Q5GAN6
  ENSP ID: ENSP00000333358
MKLNLVQIFFMLLMLLLGLGMGLGLGLHMATAVLEESDQPLNEFWSSDSQDKAEATEEGDGTQTTETLVLSNKEVVQPGWPEDPILGEDEVGGNKMLRASALFQSNKDYLRLDQTDRECNDMMAHKMKEPSQSCIAQYAFIHEDLNTVKAVCNSPVIACELKGGKCHKSSRPFDLTLCELSQPDQVTPNCNYLTSVIKKHIIITCNDMKRQLPTGQ

SEQ ID NO: 73771 - protein, 244 aa, Homo sapiens
  Payload ID: 14599
  Gene Symbol: RNASE10
  Gene Name: ribonuclease, RNase A family, 10 (non-active)
  Uniprot ID: Q5GAN6
  ENSP ID: ENSP00000392996
MWGAPLPRRPVWDVRSASAGPQPCLGGKMKLNLVQIFFMLLMLLLGLGMGLGLGLHMATAVLEESDQPLNEFWSSDSQDKAEATEEGDGTQTTETLVLSNKEVVQPGWPEDPILGEDEVGGNKMLRASALFQSNKDYLRLDQTDRECNDMMAHKMKEPSQSCIAQYAFIHEDLNTVKAVCNSPVIACELKGGKCHKSSRPFDLTLCELSQPDQVTPNCNYLTSVIKKHIIITCNDMKRQLPTGQ

SEQ ID NO: 73772 - protein, 199 aa, Homo sapiens
  Payload ID: 14600
  Gene Symbol: RNASE11
  Gene Name: ribonuclease, RNase A family, 11 (non-active)
  Uniprot ID: Q8TAA1
  ENSP ID: ENSP00000381092
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 73773 - protein, 199 aa, Homo sapiens; identical to SEQ ID NO: 73772
  Payload ID: 14600
  Gene Symbol: RNASE11
  Gene Name: ribonuclease, RNase A family, 11 (non-active)
  Uniprot ID: Q8TAA1
  ENSP ID: ENSP00000381093

SEQ ID NO: 73774 - protein, 199 aa, Homo sapiens; identical to SEQ ID NO: 73772
  Payload ID: 14600
  Gene Symbol: RNASE11
  Gene Name: ribonuclease, RNase A family, 11 (non-active)
  Uniprot ID: Q8TAA1
  ENSP ID: ENSP00000395210

SEQ ID NO: 73775 - protein, 178 aa, Homo sapiens
  Payload ID: 14600
  Gene Symbol: RNASE11
  Gene Name: ribonuclease, RNase A family, 11 (non-active)
  ENSP ID: ENSP00000401398
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLE

SEQ ID NO: 73776 - protein, 142 aa, Homo sapiens
  Payload ID: 14600
  Gene Symbol: RNASE11
  Gene Name: ribonuclease, RNase A family, 11 (non-active)
  ENSP ID: ENSP00000415954
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQN

SEQ ID NO: 73777 - protein, 199 aa, Homo sapiens; identical to SEQ ID NO: 73772
  Payload ID: 14600
  Gene Symbol: RNASE11
  Gene Name: ribonuclease, RNase A family, 11 (non-active)
  Uniprot ID: Q8TAA1
  ENSP ID: ENSP00000451318

SEQ ID NO: 73778 - protein, 136 aa, Homo sapiens
  Payload ID: 14600
  Gene Symbol: RNASE11
  Gene Name: ribonuclease, RNase A family, 11 (non-active)
  ENSP ID: ENSP00000451466
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPS

SEQ ID NO: 73779 - protein, 199 aa, Homo sapiens; identical to SEQ ID NO: 73772
  Payload ID: 14600
  Gene Symbol: RNASE11
  Gene Name: ribonuclease, RNase A family, 11 (non-active)
  Uniprot ID: Q8TAA1
  ENSP ID: ENSP00000451563

SEQ ID NO: 73780 - protein, 178 aa, Homo sapiens; identical to SEQ ID NO: 73775
  Payload ID: 14600
  Gene Symbol: RNASE11
  Gene Name: ribonuclease, RNase A family, 11 (non-active)
  ENSP ID: ENSP00000451839

SEQ ID NO: 73781 - protein, 171 aa, Homo sapiens
  Payload ID: 14600
  Gene Symbol: RNASE11
  Gene Name: ribonuclease, RNase A family, 11 (non-active)
  ENSP ID: ENSP00000452412
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQY

SEQ ID NO: 73782 - protein, 199 aa, Homo sapiens; identical to SEQ ID NO: 73772
  Payload ID: 14600
  Gene Symbol: RNASE11
  Gene Name: ribonuclease, RNase A family, 11 (non-active)
  Uniprot ID: Q8TAA1
  ENSP ID: ENSP00000482059

SEQ ID NO: 73783 - protein, 147 aa, Homo sapiens
  Payload ID: 14601
  Gene Symbol: RNASE12
  Gene Name: ribonuclease, RNase A family, 12 (non-active)
  Uniprot ID: Q5GAN4
  ENSP ID: ENSP00000450580
MIIMVIIFLVLLFWENEVNDEAVMSTLEHLHVDYPQNDVPVPARYCNHMIIQRVIREPDHTCKKEHVFIHERPRKINGICISPKKVACQNLSAIFCFQSETKFKMTVCQLIEGTRYPACRYHYSPTEGFVLVTCDDLRPDSFLGYVK

SEQ ID NO: 73784 - protein, 156 aa, Homo sapiens
  Payload ID: 14602
  Gene Symbol: RNASE13
  Gene Name: ribonuclease, RNase A family, 13 (non-active)
  Uniprot ID: Q5GAN3
  ENSP ID: ENSP00000372410
MAPAVTRLLFLQLVLGPTLVMDIKMQIGSRNFYTLSIDYPRVNYPKGFRGYCNGLMSYMRGKMQNSDCPKIHYVIHAPWKAIQKFCKYSDSFCENYNEYCTLTQDSLPITVCSLSHQQPPTSCYYNSTLTNQKLYLLCSRKYEADPIGIAGLYSGI

SEQ ID NO: 73785 - protein, 161 aa, Homo sapiens
  Payload ID: 14603
  Gene Symbol: RNASE2
  Gene Name: ribonuclease, RNase A family, 2 (liver, eosinophil-derived neurotoxin)
  Uniprot ID: P10153
  ENSP ID: ENSP00000303276
MVPKLFTSQICLLLLLGLLAVEGSLHVKPPQFTWAQWFETQHINMTSQQCTNAMQVINNYQRRCKNQNTFLLTTFANVVNVCGNPNMTCPSNKTRKNCHHSGSQVPLIHCNLTTPSPQNISNCRYAQTPANMFYIVACDNRDQRRDPPQYPVVPVHLDRII

SEQ ID NO: 73786 - protein, 160 aa, Homo sapiens
  Payload ID: 14604
  Gene Symbol: RNASE3
  Gene Name: ribonuclease, RNase A family, 3
  Uniprot ID: P12724
  ENSP ID: ENSP00000302324
MVPKLFTSQICLLLLLGLMGVEGSLHARPPQFTRAQWFAIQHISLNPPRCTIAMRAINNYRWRCKNQNTFLRTTFANVVNVCGNQSIRCPHNRTLNNCHRSRFRVPLLHCDLINPGAQNISNCTYADRPGRRFYVVACDNRDPRDSPRYPVVPVHLDTTI

SEQ ID NO: 73787 - protein, 147 aa, Homo sapiens
  Payload ID: 14605
  Gene Symbol: RNASE4
  Gene Name: ribonuclease, RNase A family, 4
  Uniprot ID: P34096
  ENSP ID: ENSP00000381081
MALQRTHSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 73788 - protein, 147 aa, Homo sapiens; identical to SEQ ID NO: 73787
  Payload ID: 14605
  Gene Symbol: RNASE4
  Gene Name: ribonuclease, RNase A family, 4
  Uniprot ID: P34096
  ENSP ID: ENSP00000451624

SEQ ID NO: 73789 - protein, 147 aa, Homo sapiens; identical to SEQ ID NO: 73787
  Payload ID: 14605
  Gene Symbol: RNASE4
  Gene Name: ribonuclease, RNase A family, 4
  Uniprot ID: P34096
  ENSP ID: ENSP00000452245

SEQ ID NO: 73790 - protein, 156 aa, Homo sapiens
  Payload ID: 14606
  Gene Symbol: RNASE7
  Gene Name: ribonuclease, RNase A family, 7
  Uniprot ID: Q9H1E1
  ENSP ID: ENSP00000298690
MAPARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGAVSLTMCKLTSGKHPNCRYKEKRQNKSYVVACKPPQKKDSQQFHLVPVHLDRVL

SEQ ID NO: 73791 - protein, 156 aa, Homo sapiens; identical to SEQ ID NO: 73790
  Payload ID: 14606
  Gene Symbol: RNASE7
  Gene Name: ribonuclease, RNase A family, 7
  Uniprot ID: Q9H1E1
  ENSP ID: ENSP00000431382

SEQ ID NO: 73792 - protein, 154 aa, Homo sapiens
  Payload ID: 14607
  Gene Symbol: RNASE8
  Gene Name: ribonuclease, RNase A family, 8
  Uniprot ID: Q8TDE3
  ENSP ID: ENSP00000311398
MAPARAGCCPLLLLLLGLWVAEVLVRAKPKDMTSSQWFKTQHVQPSPQACNSAMSIINKYTERCKDLNTFLHEPFSSVAITCQTPNIACKNSCKNCHQSHGPMSLTMGELTSGKYPNCRYKEKHLNTPYIVACDPPQQGDPGYPLVPVHLDKVV

SEQ ID NO: 73793 - protein, 205 aa, Homo sapiens
  Payload ID: 14608
  Gene Symbol: RNASE9
  Gene Name: ribonuclease, RNase A family, 9 (non-active)
  Uniprot ID: P60153
  ENSP ID: ENSP00000340162
MMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLSEDGVFVISP

SEQ ID NO: 73794 - protein, 210 aa, Homo sapiens
  Payload ID: 14608
  Gene Symbol: RNASE9
  Gene Name: ribonuclease, RNase A family, 9 (non-active)
  Uniprot ID: P60153
  ENSP ID: ENSP00000384683
MSAGKMMRTLITTHPLPLLLLPQQLLQLVQFQEVDTDFDFPEEDKKEEFEECLEKFFSTGPARPPTKEKVKRRVLIEPGMPLNHIEYCNHEIMGKNVYYKHRWVAEHYFLLMQYDELQKICYNRFVPCKNGIRKCNRSKGLVEGVYCNLTEAFEIPACKYESLYRKGYVLITCSWQNEMQKRIPHTINDLVEPPEHRSFLSEDGVFVISP

SEQ ID NO: 73795 - protein, 205 aa, Homo sapiens; identical to SEQ ID NO: 73793
  Payload ID: 14608
  Gene Symbol: RNASE9
  Gene Name: ribonuclease, RNase A family, 9 (non-active)
  Uniprot ID: P60153
  ENSP ID: ENSP00000409504

SEQ ID NO: 73796 - protein, 210 aa, Homo sapiens; identical to SEQ ID NO: 73794
  Payload ID: 14608
  Gene Symbol: RNASE9
  Gene Name: ribonuclease, RNase A family, 9 (non-active)
  Uniprot ID: P60153
  ENSP ID: ENSP00000450570

SEQ ID NO: 73797 - protein, 205 aa, Homo sapiens; identical to SEQ ID NO: 73793
  Payload ID: 14608
  Gene Symbol: RNASE9
  Gene Name: ribonuclease, RNase A family, 9 (non-active)
  Uniprot ID: P60153
  ENSP ID: ENSP00000450599

SEQ ID NO: 73798 - protein, 205 aa, Homo sapiens; identical to SEQ ID NO: 73793
  Payload ID: 14608
  Gene Symbol: RNASE9
  Gene Name: ribonuclease, RNase A family, 9 (non-active)
  Uniprot ID: P60153
  ENSP ID: ENSP00000450800

SEQ ID NO: 73799 - protein, 210 aa, Homo sapiens; identical to SEQ ID NO: 73794
  Payload ID: 14608
  Gene Symbol: RNASE9
  Gene Name: ribonuclease, RNase A family, 9 (non-active)
  Uniprot ID: P60153
  ENSP ID: ENSP00000450987

SEQ ID NO: 73800 - protein, 210 aa, Homo sapiens; identical to SEQ ID NO: 73794
  Payload ID: 14608
  Gene Symbol: RNASE9
  Gene Name: ribonuclease, RNase A family, 9 (non-active)
  Uniprot ID: P60153
  ENSP ID: ENSP00000451160

SEQ ID NO: 73801 - protein, 205 aa, Homo sapiens; identical to SEQ ID NO: 73793
  Payload ID: 14608
  Gene Symbol: RNASE9
  Gene Name: ribonuclease, RNase A family, 9 (non-active)
  Uniprot ID: P60153
  ENSP ID: ENSP00000451285

SEQ ID NO: 73802 - protein, 205 aa, Homo sapiens; identical to SEQ ID NO: 73793
  Payload ID: 14608
  Gene Symbol: RNASE9
  Gene Name: ribonuclease, RNase A family, 9 (non-active)
  Uniprot ID: P60153
  ENSP ID: ENSP00000451565

SEQ ID NO: 73803 - protein, 210 aa, Homo sapiens; identical to SEQ ID NO: 73794
  Payload ID: 14608
  Gene Symbol: RNASE9
  Gene Name: ribonuclease, RNase A family, 9 (non-active)
  Uniprot ID: P60153
  ENSP ID: ENSP00000481786

SEQ ID NO: 73804 - protein, 150 aa, Homo sapiens
  Payload ID: 14609
  Gene Symbol: RNASE6
  Gene Name: ribonuclease, RNase A family, k6
  Uniprot ID: Q93091
  ENSP ID: ENSP00000302046
MVLCFPLLLLLLVLWGPVCPLHAWPKRLTKAHWFEIQHIQPSPLQCNRAMSGINNYTQHCKHQNTFLHDSFQNVAAVCDLLSIVCKNRRHNCHQSSKPVNMTDCRLTSGKYPQCRYSAAAQYKFFIVACDPPQKSDPPYKLVPVHLDSIL

SEQ ID NO: 73805 - protein, 65 aa, Homo sapiens
  Payload ID: 14610
  Gene Symbol: RNASEK
  Gene Name: ribonuclease, RNase K
  ENSP ID: ENSP00000447072
MGWLRPGPRPLCPPARASWAFSHRFPSPLAPRRSPTPFFMASLLCCGPKLAACGIVLSAWGVIML

SEQ ID NO: 73806 - protein, 71 aa, Homo sapiens
  Payload ID: 14610
  Gene Symbol: RNASEK
  Gene Name: ribonuclease, RNase K
  ENSP ID: ENSP00000447359
MLGIFFNVHSAVLIEDVPFTEKDFENGPQNIYNLYEQVSYNCFIAAGLYLLLGGFSFCQVRLNKRKEYMVR

SEQ ID NO: 73807 - protein, 137 aa, Homo sapiens
  Payload ID: 14610
  Gene Symbol: RNASEK
  Gene Name: ribonuclease, RNase K
  Uniprot ID: Q6P5S7
  ENSP ID: ENSP00000449500
MGWLRPGPRPLCPPARASWAFSHRFPSPLAPRRSPTPFFMASLLCCGPKLAACGIVLSAWGVIMLIMLGIFFNVHSAVLIEDVPFTEKDFENGPQNIYNLYEQVSYNCFIAAGLYLLLGGFSFCQVRLNKRKEYMVR

SEQ ID NO: 73808 - protein, 46 aa, Homo sapiens
  Payload ID: 14610
  Gene Symbol: RNASEK
  Gene Name: ribonuclease, RNase K
  ENSP ID: ENSP00000449670
MASLLCCGPKLAACGIVLSAWGVIMLVRGLPDNARNIFQCPFRCVD

SEQ ID NO: 73809 - protein, 133 aa, Homo sapiens
  Payload ID: 14610
  Gene Symbol: RNASEK
  Gene Name: ribonuclease, RNase K
  ENSP ID: ENSP00000450174
MKKCRFSLPSSALSRDDDASREDDNLGSWERWLGHYSHPCLDHLSQCHHLTPCSRWLSPNPIMLGIFFNVHSAVLIEDVPFTEKDFENGPQNIYNLYEQVSYNCFIAAGLYLLLGGFSFCQVRLNKRKEYMVR

SEQ ID NO: 73810 - protein, 55 aa, Homo sapiens
  Payload ID: 14610
  Gene Symbol: RNASEK
  Gene Name: ribonuclease, RNase K
  ENSP ID: ENSP00000450182
MKKCRFSLPSSALSRDDDASREDDNLGSWERWLGHYSHPCLDHLSQCHHLTPCSR

SEQ ID NO: 73811 - protein, 71 aa, Homo sapiens; identical to SEQ ID NO: 73806
  Payload ID: 14610
  Gene Symbol: RNASEK
  Gene Name: ribonuclease, RNase K
  ENSP ID: ENSP00000459471

SEQ ID NO: 73812 - protein, 98 aa, Homo sapiens
  Payload ID: 14610
  Gene Symbol: RNASEK
  Gene Name: ribonuclease, RNase K
  ENSP ID: ENSP00000468923
MASLLCCGPKLAACGIVLSAWGVIMLIMLGIFFNVHSAVLIEDVPFTEKDFENGPQNIYNLYEQVSYNCFIAAGLYLLLGGFSFCQVRLNKRKEYMVR

SEQ ID NO: 73813 - protein, 461 aa, Homo sapiens [sequence omitted]

SEQ ID NO: 73814 - protein, 461 aa, Homo sapiens [sequence omitted]

SEQ ID NO: 73815 - protein, 461 aa, Homo sapiens [sequence omitted]

SEQ ID NO: 73816 - protein, 461 aa, Homo sapiens [sequence omitted]

SEQ ID NO: 73817 - protein, 461 aa, Homo sapiens [sequence omitted]

SEQ ID NO: 73818 - protein, 461 aa, Homo sapiens [sequence omitted]

SEQ ID NO: 73819 - protein, 77 aa, Homo sapiens
  Payload ID: 14611
  Gene Symbol: RNH1
  Gene Name: ribonuclease/angiogenin inhibitor 1
  ENSP ID: ENSP00000431201
MSLDIQSLDIQCEELSDARWAELLPLLQQCQVVRLDDCGLTEARCKDISSALRVNPALAELNLRSNELGDVGCPTAV

SEQ ID NO: 73820 - protein, 285 aa, Homo sapiens
  Payload ID: 14611
  Gene Symbol: RNH1
  Gene Name: ribonuclease/angiogenin inhibitor 1
  ENSP ID: ENSP00000432170
ESCGVTSDNCRDLCGIVASKASLRELALGSNKLGDVGMAELCPGLLHPSSRLRTLWIWECGITAKGCGDLCRVLRAKESLKELSLAGNELGDEGARLLCETLLEPGCQLESLWVKSCSFTAACCSHFSSVLAQNRFLLELQISNNRLEDAGVRELCQGLGQPGSVLRVLWLADCDVSDSSCSSLAATLLANHSLRELDLSNNCLGDAGILQLVESVRQPGCLLEQLVYVHALGGWCGQGCPGRKAGVGEDTGPCLPSGLCAACTTFTGLRRWRTGCRPWRRTSHP

SEQ ID NO: 73821 - protein, 8 aa, Homo sapiens
  Payload ID: 14611
  Gene Symbol: RNH1
  Gene Name: ribonuclease/angiogenin inhibitor 1
  ENSP ID: ENSP00000432781
MSLDIQSL

SEQ ID NO: 73822 - protein, 168 aa, Homo sapiens
  Payload ID: 14611
  Gene Symbol: RNH1
  Gene Name: ribonuclease/angiogenin inhibitor 1
  ENSP ID: ENSP00000433033
MSLDIQSLDIQCEELSDARWAELLPLLQQCQVVRLDDCGLTEARCKDISSALRVNPALAELNLRSNELGDVGVHCVLQGLQTPSCKIQKLRSCTSATTSWGMRACSCSAKDSWTPSAAWKSCSWSIAASRLPAASPWPPCSGPSRTSRSSRLATTTSMRLASVCCARA

SEQ ID NO: 73823 - protein, 461 aa, Homo sapiens [sequence omitted]

SEQ ID NO: 73824 - protein, 189 aa, Homo sapiens
  Payload ID: 14611
  Gene Symbol: RNH1
  Gene Name: ribonuclease/angiogenin inhibitor 1
  ENSP ID: ENSP00000434947
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRV

SEQ ID NO: 73825 - protein, 40 aa, Homo sapiens
  Payload ID: 14611
  Gene Symbol: RNH1
  Gene Name: ribonuclease/angiogenin inhibitor 1
  ENSP ID: ENSP00000434971
MSLDIQSLDIQCEELSDARWAELLPLLQQCQVVRLDDCGL

SEQ ID NO: 73826 - protein, 194 aa, Homo sapiens
  Payload ID: 14611
  Gene Symbol: RNH1
  Gene Name: ribonuclease/angiogenin inhibitor 1
  ENSP ID: ENSP00000435057
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGL

SEQ ID NO: 73827 - protein, 461 aa, Homo sapiens [sequence omitted]

SEQ ID NO: 73828 - protein, 199 aa, Homo sapiens
  Payload ID: 14611
  Gene Symbol: RNH1
  Gene Name: ribonuclease/angiogenin inhibitor 1
  ENSP ID: ENSP00000435748
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLQLEYCSLSAASCEPLASVLRAKPDFKELTVSNNDINEAGVRVLCQGLKDSPC

SEQ ID NO: 73829 - protein, 181 aa, Homo sapiens
  Payload ID: 14611
  Gene Symbol: RNH1
  Gene Name: ribonuclease/angiogenin inhibitor 1
  ENSP ID: ENSP00000435798
MSLDIQSLDIQCEELSDARWAELLPLLQQCQVVRLDDCGLTEARCKDISSALRVNPALAELNLRSNELGDVGVHCVLQGLQTPSCKIQKLSLQNCCLTGAGCGVLSSTLRTLPTLQELHLSDNLLGDAGLQLLCEGLLDPQCRLEKLHCPLQGTAAPGPDGGNRCLAVSQVPLTASVCVGD

SEQ ID NO: 73830 - protein, 35 aa, Homo sapiens
  Payload ID: 14611
  Gene Symbol: RNH1
  Gene Name: ribonuclease/angiogenin inhibitor 1
  ENSP ID: ENSP00000436022
MSLDIQSLDIQCEELSDARWAELLPLLQQCQVVRL

SEQ ID NO: 73831 - protein, 461 aa, Homo sapiens [sequence omitted]

SEQ ID NO: 73832 - protein, 461 aa, Homo sapiens [sequence omitted]

SEQ ID NO: 73833 - protein, 461 aa, Homo sapiens [sequence omitted]

SEQ ID NO: 73834 - protein, 461 aa, Homo sapiens [sequence omitted]

SEQ ID NO: 73835 - protein, 461 aa, Homo sapiens [sequence omitted]

SEQ ID NO: 73836 - protein, 189 aa, Homo sapiens; identical to SEQ ID NO: 73824
  Payload ID: 14611
  Gene Symbol: RNH1
  Gene Name: ribonuclease/angiogenin inhibitor 1
  ENSP ID: ENSP00000487751

SEQ ID NO: 73837 - protein, 461 aa, Homo sapiens [sequence omitted]

SEQ ID NO: 73838 - protein, 461 aa, Homo sapiens [sequence omitted]

SEQ ID NO: 73839 - protein, 194 aa, Homo sapiens; identical to SEQ ID NO: 73826
  Payload ID: 14611
  Gene Symbol: RNH1
  Gene Name: ribonuclease/angiogenin inhibitor 1
  ENSP ID: ENSP00000488030

SEQ ID NO: 73840 - protein, 77 aa, Homo sapiens; identical to SEQ ID NO: 73819
  Payload ID: 14611
  Gene Symbol: RNH1
  Gene Name: ribonuclease/angiogenin inhibitor 1
  ENSP ID: ENSP00000488114

SEQ ID NO: 73841 - protein, 8 aa, Homo sapiens
  Payload ID: 14611
  Gene Symbol: RNH1
  Gene Name: ribonuclease/angiogenin inhibitor 1
  ENSP ID: ENSP00000488337
MSLDIQSL

SEQ ID NO: 73842 - protein, 40 aa, Homo sapiens; identical to SEQ ID NO: 73825
  Payload ID: 14611
  Gene Symbol: RNH1
  Gene Name: ribonuclease/angiogenin inhibitor 1
  ENSP ID: ENSP00000488388

SEQ ID NO: 73843 - protein, 285 aa, Homo sapiens; identical to SEQ ID NO: 73820
  Payload ID: 14611
  Gene Symbol: RNH1
  Gene Name: ribonuclease/angiogenin inhibitor 1
  ENSP ID: ENSP00000488547

SEQ ID NO: 73844 - protein, 199 aa, Homo sapiens; identical to SEQ ID NO: 73828
  Payload ID: 14611
  Gene Symbol: RNH1
  Gene Name: ribonuclease/angiogenin inhibitor 1
  ENSP ID: ENSP00000488555

SEQ ID NO: 73845 - protein, 461 aa, Homo sapiens [sequence omitted]

SEQ ID NO: 73846 - protein, 35 aa, Homo sapiens; identical to SEQ ID NO: 73830
  Payload ID: 14611
  Gene Symbol: RNH1
  Gene Name: ribonuclease/angiogenin inhibitor 1
  ENSP ID: ENSP00000488849

SEQ ID NO: 73847 - protein, 368 aa, Homo sapiens
  Payload ID: 14612
  Gene Symbol: RAE1
  Gene Name: ribonucleic acid export 1
  Uniprot ID: P78406
  ENSP ID: ENSP00000360286
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKGHEFYNPQKKNYIFLRNAAEELKPRNKK

SEQ ID NO: 73848 - protein, 368 aa, Homo sapiens; identical to SEQ ID NO: 73847
  Payload ID: 14612
  Gene Symbol: RAE1
  Gene Name: ribonucleic acid export 1
  Uniprot ID: P78406
  ENSP ID: ENSP00000379181

SEQ ID NO: 73849 - protein, 368 aa, Homo sapiens; identical to SEQ ID NO: 73847
  Payload ID: 14612
  Gene Symbol: RAE1
  Gene Name: ribonucleic acid export 1
  Uniprot ID: P78406
  ENSP ID: ENSP00000379182

SEQ ID NO: 73850 - protein, 137 aa, Homo sapiens
  Payload ID: 14612
  Gene Symbol: RAE1
  Gene Name: ribonucleic acid export 1
  ENSP ID: ENSP00000392097
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIK

SEQ ID NO: 73851 - protein, 137 aa, Homo sapiens; identical to SEQ ID NO: 73850
  Payload ID: 14612
  Gene Symbol: RAE1
  Gene Name: ribonucleic acid export 1
  ENSP ID: ENSP00000393264

SEQ ID NO: 73852 - protein, 87 aa, Homo sapiens
  Payload ID: 14612
  Gene Symbol: RAE1
  Gene Name: ribonucleic acid export 1
  ENSP ID: ENSP00000402924
MSLFGTTSGFGTSGTSMFGSATTDNHNPMKDIEVTSSPDDSIGCLSFSPPTLPGNFLIAGSWANDVRCWEVQDSGQTIPKAQQMHTG

SEQ ID NO: 73853 - protein, 437 aa, Homo sapiens
  Payload ID: 14612
  Gene Symbol: RAE1
  Gene Name: ribonucleic acid export 1
  ENSP ID: ENSP00000432609
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKVRTPGPALGAPRQQSQALGSEGLGLSCDSSQDSRVSLGRSPSPPCKGKLQDFLKWLWGFSTAFGQNPAHRKCSASVSHYGLLCSWAQKHRQAGGCTL

SEQ ID NO: 73854 - protein, 217 aa, Homo sapiens
  Payload ID: 14612
  Gene Symbol: RAE1
  Gene Name: ribonucleic acid export 1
  ENSP ID: ENSP00000432698
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQRQR

SEQ ID NO: 73855 - protein, 756 aa, Homo sapiens
  Payload ID: 14613
  Gene Symbol: RAVER1
  Gene Name: ribonucleoprotein, PTB-binding 1
  ENSP ID: ENSP00000293677
MPLRPGSLVPEGAGFPKMAADVSVTHRPPLSPKSGAEVEAGDAAERRAPEEELPPLDPEEIRKRLEHTERQFRNRRKILIRGLPGDVTNQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGLQKDSGPLPTPPGVSLLGEPPKDYRIPLNPYLNLHSLLPASNLAGKEARGWGGAGRSRRPAEGPPTNPPAPGGGSSSSKAFQLKSRLLSPLSSARLPPEPGLSDSYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 73856 - protein, 96 aa, Homo sapiens
  Payload ID: 14613
  Gene Symbol: RAVER1
  Gene Name: ribonucleoprotein, PTB-binding 1
  ENSP ID: ENSP00000465753
  MOD_RES (1)..(1): Any amino acid
XVTHRPPLSPKSGAEVEAGDAAERRAPEEELPPLDPEEIRKRLEHTERQFRNRRKILIRGLPGDVTNQEVHDLLSDYELKYCFVDKYKGTEPPAGA

SEQ ID NO: 73857 - protein, 130 aa, Homo sapiens
  Payload ID: 14613
  Gene Symbol: RAVER1
  Gene Name: ribonucleoprotein, PTB-binding 1
  ENSP ID: ENSP00000468375
GGKQGLLGAPPAMPLLNGPALSTALLQLALQTQGQKKPGILGDSPLGALQPGAQPANPLLGELPAGLTAGGAPQGLPDSPESLPEPTQPAPGQQPGGPWRWQQQQQSLPAQVPPAQPPQQRPPAPRTRTV

SEQ ID NO: 73858 - protein, 606 aa, Homo sapiens
  Payload ID: 14613
  Gene Symbol: RAVER1
  Gene Name: ribonucleoprotein, PTB-binding 1
  Uniprot ID: Q8IY67
  ENSP ID: ENSP00000479520
MAADVSVTHRPPLSPKSGAEVEAGDAAERRAPEEELPPLDPEEIRKRLEHTERQFRNRRKILIRGLPGDVTNQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGPLSHFYSGSPTSYFTSGLQAGLKQSHLSKAIGSSPLGSGEGLLGLSPGPNGHSHLLKVRAGGGDMQGWEAPAPQRPLTRPALPSVSRPHWAARNAALPTCCPRPSPAQKAAMWASTPRASAATTRTPT

SEQ ID NO: 73859 - protein, 739 aa, Homo sapiens
  Payload ID: 14613
  Gene Symbol: RAVER1
  Gene Name: ribonucleoprotein, PTB-binding 1
  ENSP ID: ENSP00000482277
MAADVSVTHRPPLSPKSGAEVEAGDAAERRAPEEELPPLDPEEIRKRLEHTERQFRNRRKILIRGLPGDVTNQEVHDLLSDYELKYCFVDKYKGTAFVTLLNGEQAEAAINAFHQSRLRERELSVQLQPTDALLCVANLPPSLTQQQFEELVRPFGSLERCFLVYSERTGQSKGYGFAEYMKKDSAARAKSDLLGKPLGPRTLYVHWTDAGQLTPALLHSRCLCVDRLPPGFNDVDALCRALSAVHSPTFCQLACGQDGQLKGFAVLEYETAEMAEEAQQQADGLSLGGSHLRVSFCAPGPPGRSMLAALIAAQATALNRGKGLLPEPNILQLLNNLGPSASLQLLLNPLLHGSAGGKQGLLGAPPAMPLLNGPALSTALLQLALQTQGQKKPGILGDSPLGALQPGAQPANPLLGELPAGGGLPPELPPRRGKPPPLLPSVLGPAGGDREALGLGPPAAQLTPPPAPVGLRGSGLRGLQKDSGPLPTPPGVSLLGEPPKDYRIPLNPYLNLHSLLPASNLAGKEARGWGGAGRSRRPAEGPPTNPPAPGGGSSSSKAFQLKSRLLSPLSSARLPPEPGLSDSYSFDYPSDMGPRRLFSHPREPALGPHGPSRHKMSPPPSGFGERSSGGSGGGPLSHFYSGSPTSYFTSGLQAGLKQSHLSKAIGSSPLGSGEGLLGLSPGPNGHSHLLKTPLGGQKRSFAHLLPSPEPSPEGSYVGQHSQGLGGHYADSYLKRKRIF

SEQ ID NO: 73860 - protein, 756 aa, Homo sapiens; identical to SEQ ID NO: 73855
  Payload ID: 14613
  Gene Symbol: RAVER1
  Gene Name: ribonucleoprotein, PTB-binding 1
  ENSP ID: ENSP00000482486

SEQ ID NO: 73861 - protein, 691 aa, Homo sapiens
  Payload ID: 14614
  Gene Symbol: RAVER2
  Gene Name: ribonucleoprotein, PTB-binding 2
  Uniprot ID: Q9HCJ3
  ENSP ID: ENSP00000294428
MAAAAGDGGGEGGAGLGSAAGLGPGPGLRGQGPSAEAHEGAPDPMPAALHPEEVAARLQRMQRELSNRRKILVKNLPQDSNCQEVHDLLKDYDLKYCYVDRNKRTAFVTLLNGEQAQNAIQMFHQYSFRGKDLIVQLQPTDALLCITNVPISFTSEEFEELVRAYGNIERCFLVYSEVTGHSKGYGFVEYMKKDFAAKARLELLGRQLGASALFAQWMDVNLLASELIHSKCLCIDKLPSDYRDSEELLQIFSSVHKPVFCQLAQDEGSYVGGFAVVEYSTAEQAEEVQQAADGMTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQSSVMGNTSNLFLQNLSHIPLAQQQLMKFENIHTNNKPGLLGEPPAVVLQTALGIGSVLPLKKELGHHHGEAHKTSSLIPTQTTITAGMGMLPFFPNQHIAGQAGPGHSNTQEKQPATVGMAEGNFSGSQPYLQSFPNLAAGSLLVGHHKQQQSQPKGTEISSGAASKNQTSLLGEPPKEIRLSKNPYLNLASVLPSVCLSSPASKTTLHKTGIASSILDAISQGSESQHALEKCIAYSPPFGDYAQVSSLRNEKRGSSYLISAPEGGSVECVDQHSQGTGAYYMETYLKKKRVY

SEQ ID NO: 73862 - protein, 678 aa, Homo sapiens
  Payload ID: 14614
  Gene Symbol: RAVER2
  Gene Name: ribonucleoprotein, PTB-binding 2
  Uniprot ID: Q9HCJ3
  ENSP ID: ENSP00000360112
MAAAAGDGGGEGGAGLGSAAGLGPGPGLRGQGPSAEAHEGAPDPMPAALHPEEVAARLQRMQRELSNRRKILVKNLPQDSNCQEVHDLLKDYDLKYCYVDRNKRTAFVTLLNGEQAQNAIQMFHQYSFRGKDLIVQLQPTDALLCITNVPISFTSEEFEELVRAYGNIERCFLVYSEVTGHSKGYGFVEYMKKDFAAKARLELLGRQLGASALFAQWMDVNLLASELIHSKCLCIDKLPSDYRDSEELLQIFSSVHKPVFCQLAQDEGSYVGGFAVVEYSTAEQAEEVQQAADGMTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQNLSHIPLAQQQLMKFENIHTNNKPGLLGEPPAVVLQTALGIGSVLPLKKELGHHHGEAHKTSSLIPTQTTITAGMGMLPFFPNQHIAGQAGPGHSNTQEKQPATVGMAEGNFSGSQPYLQSFPNLAAGSLLVGHHKQQQSQPKGTEISSGAASKNQTSLLGEPPKEIRLSKNPYLNLASVLPSVCLSSPASKTTLHKTGIASSILDAISQGSESQHALEKCIAYSPPFGDYAQVSSLRNEKRGSSYLISAPEGGSVECVDQHSQGTGAYYMETYLKKKRVY

SEQ ID NO: 73863 - protein, 166 aa, Homo sapiens
  Payload ID: 14614
  Gene Symbol: RAVER2
  Gene Name: ribonucleoprotein, PTB-binding 2
  ENSP ID: ENSP00000397069
MTIKGSKVQVSFCAPGAPGRSTLAALIAAQRVMHSNQKGLLPEPNPVQIMKSLNNPAMLQVLLQPQLCGRAVKPAVLGTPHSLPHLMNPSISPAFLHLNKAHQNLSHIPLAQQQLMKFENIHTNNKPGLLGEPPAVVLQTALGIGSVLPLKKELGHHHGEAHKSCL

SEQ ID NO: 73864 - protein, 792 aa, Homo sapiens
  Payload ID: 14615
  Gene Symbol: RRM1
  Gene Name: ribonucleotide reductase M1
  Uniprot ID: P23921
  ENSP ID: ENSP00000300738
MHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 73865 - protein, 570 aa, Homo sapiens
  Payload ID: 14615
  Gene Symbol: RRM1
  Gene Name: ribonucleotide reductase M1
  ENSP ID: ENSP00000431464
MKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 73866 - protein, 130 aa, Homo sapiens
  Payload ID: 14615
  Gene Symbol: RRM1
  Gene Name: ribonucleotide reductase M1
  ENSP ID: ENSP00000432555
  MOD_RES (1)..(1): Any amino acid
XTYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRIMIYLPLASWGICYLPGALAFRHL

SEQ ID NO: 73867 - protein, 37 aa, Homo sapiens
  Payload ID: 14615
  Gene Symbol: RRM1
  Gene Name: ribonucleotide reductase M1
  ENSP ID: ENSP00000434069
MHVIKRDGRQERVMFDKITSRIQKLCYGLNMDFVDPM

SEQ ID NO: 73868 - protein, 69 aa, Homo sapiens
  Payload ID: 14615
  Gene Symbol: RRM1
  Gene Name: ribonucleotide reductase M1
  ENSP ID: ENSP00000435656
MHVIKRDGRQERVMFDKITSRIQKLCYGLNMDFVDPGLTLPPRLECSGIITAHCSLSFPSSWDHRLRSP

SEQ ID NO: 73869 - protein, 75 aa, Homo sapiens
  Payload ID: 14615
  Gene Symbol: RRM1
  Gene Name: ribonucleotide reductase M1
  ENSP ID: ENSP00000436377
MKDDSIEGIYDTLKQCALISKSAGGIGVAVSCIRATGSYIAGTNGNSNGLVPMLRVYNNTARYVDQGGNKVCSMN

SEQ ID NO: 73870 - protein, 389 aa, Homo sapiens
  Payload ID: 14616
  Gene Symbol: RRM2
  Gene Name: ribonucleotide reductase M2
  Uniprot ID: P31350
  ENSP ID: ENSP00000302955
MLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 73871 - protein, 449 aa, Homo sapiens
  Payload ID: 14616
  Gene Symbol: RRM2
  Gene Name: ribonucleotide reductase M2
  Uniprot ID: P31350
  ENSP ID: ENSP00000353770
MGRVGGMAQPMGRAGAPKPMGRAGSARRGRFKGCWSEGSPVHPVPAVLSWLLALLRCASTMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 73872 - protein, 289 aa, Homo sapiens
  Payload ID: 14616
  Gene Symbol: RRM2
  Gene Name: ribonucleotide reductase M2
  ENSP ID: ENSP00000419177
MFYFLPQQKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSK

SEQ ID NO: 73873 - protein, 449 aa, Homo sapiens; identical to SEQ ID NO: 73871
  Payload ID: 14616
  Gene Symbol: RRM2
  Gene Name: ribonucleotide reductase M2
  Uniprot ID: P31350
  ENSP ID: ENSP00000484183

SEQ ID NO: 73874 - protein, 351 aa, Homo sapiens
  Payload ID: 14617
  Gene Symbol: RRM2B
  Gene Name: ribonucleotide reductase M2 B (TP53 inducible)
  Uniprot ID: Q7LG56
  ENSP ID: ENSP00000251810
MGDPERPEAAGLDQDERSSSDTNESEIKSNEEPLLRKSSRRFVIFPIQYPDIWKMYKQAQASFWTAEEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 73875 - protein, 299 aa, Homo sapiens
  Payload ID: 14617
  Gene Symbol: RRM2B
  Gene Name: ribonucleotide reductase M2 B (TP53 inducible)
  Uniprot ID: Q7LG56
  ENSP ID: ENSP00000379248
MGDPERPEAAGLDQDEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 73876 - protein, 65 aa, Homo sapiens
  Payload ID: 14617
  Gene Symbol: RRM2B
  Gene Name: ribonucleotide reductase M2 B (TP53 inducible)
  ENSP ID: ENSP00000427830
MGDPERPEAAGLDQDEMESCSVTRPECSGVISAHCNLCLLGSSDSPASASRVAGTTEIIFRHQRK

SEQ ID NO: 73877 - protein, 408 aa, Homo sapiens
  Payload ID: 14617
  Gene Symbol: RRM2B
  Gene Name: ribonucleotide reductase M2 B (TP53 inducible)
  ENSP ID: ENSP00000428115
  MOD_RES (1)..(1): Any amino acid
XDCKLQDRCRKCYSPRSGQACPPALAAAWLRRCERRGGRPRGGRRKELTLGLRPARCSAPGPAKDDAWRPQAGRSSSDTNESEIKSNEEPLLRKSSRRFVIFPIQYPDIWKMYKQAQASFWTAEEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 73878 - protein, 66 aa, Homo sapiens
  Payload ID: 14617
  Gene Symbol: RRM2B
  Gene Name: ribonucleotide reductase M2 B (TP53 inducible)
  Uniprot ID: Q7LG56
  ENSP ID: ENSP00000429140
MGDPERPEAAGLDQDEVFQAENPFDFMENISLEGKTNFFEKRVSEYQRFAVMAETTDNVFTLDADF

SEQ ID NO: 73879 - protein, 43 aa, Homo sapiens
  Payload ID: 14617
  Gene Symbol: RRM2B
  Gene Name: ribonucleotide reductase M2 B (TP53 inducible)
  Uniprot ID: Q7LG56
  ENSP ID: ENSP00000429578
MGDPERPEAAGLDQDERSSSDTNESEIKSNEEPLLRKSSRRSF

SEQ ID NO: 73880 - protein, 139 aa, Homo sapiens
  Payload ID: 14617
  Gene Symbol: RRM2B
  Gene Name: ribonucleotide reductase M2 B (TP53 inducible)
  Uniprot ID: Q7LG56
  ENSP ID: ENSP00000430641
MGDPERPEAAGLDQDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 73881 - protein, 297 aa, Homo sapiens
  Payload ID: 14617
  Gene Symbol: RRM2B
  Gene Name: ribonucleotide reductase M2 B (TP53 inducible)
  ENSP ID: ENSP00000484318
MYKQAQASFWTAEEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 73882 - protein, 607 aa, Homo sapiens
  Payload ID: 14618
  Gene Symbol: RPN1
  Gene Name: ribophorin I
  Uniprot ID: P04843
  ENSP ID: ENSP00000296255
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 73883 - protein, 435 aa, Homo sapiens
  Payload ID: 14618
  Gene Symbol: RPN1
  Gene Name: ribophorin I
  ENSP ID: ENSP00000417529
MRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 73884 - protein, 121 aa, Homo sapiens
  Payload ID: 14618
  Gene Symbol: RPN1
  Gene Name: ribophorin I
  ENSP ID: ENSP00000419384
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKRVCCPGSITVVPC

SEQ ID NO: 73885 - protein, 631 aa, Homo sapiens
  Payload ID: 14619
  Gene Symbol: RPN2
  Gene Name: ribophorin II
  Uniprot ID: P04844
  ENSP ID: ENSP00000237530
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 73886 - protein, 615 aa, Homo sapiens
  Payload ID: 14619
  Gene Symbol: RPN2
  Gene Name: ribophorin II
  Uniprot ID: P04844
  ENSP ID: ENSP00000362724
MAPPGSSTVFLLALTIIASTWALTPTHYLTKHDVERLKASLDRPFTNLESAFYSIVGLSSLGAQVPDAKISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRIAAEQSSRLAKYRTLRTAH

SEQ ID NO: 73887 - protein, 344 aa, Homo sapiens
  Payload ID: 14619
  Gene Symbol: RPN2
  Gene Name: ribophorin II
  ENSP ID: ENSP00000362735
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLARVWSTVLESRSLFSKRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPV

SEQ ID NO: 73888 - protein, 166 aa, Homo sapiens
  Payload ID: 14619
  Gene Symbol: RPN2
  Gene Name: ribophorin II
  ENSP ID: ENSP00000399137
MQRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKT

SEQ ID NO: 73889 - protein, 147 aa, Homo sapiens
  Payload ID: 14619
  Gene Symbol: RPN2
  Gene Name: ribophorin II
  ENSP ID: ENSP00000399404
  MOD_RES (1)..(1): Any amino acid
XGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAEQHISSRRKMEILKTECQEKESRTIHSMRRKMEKKNFI

SEQ ID NO: 73890 - protein, 138 aa, Homo sapiens
  Payload ID: 14619
  Gene Symbol: RPN2
  Gene Name: ribophorin II
  ENSP ID: ENSP00000409580
ELDTSERKIEFDSASGTYTLYLIIGDATLKNPILWNVADVVIKFPEEEAPSTVLSQNLFTPKQEIQWIRIGANVSNFTFAPSTIIFHLGHAAMLGLMYVYWTQLNMFQTLKYLAILGSVTFLAGNRMLAQQAVKRTAH

SEQ ID NO: 73891 - protein, 162 aa, Homo sapiens
  Payload ID: 14619
  Gene Symbol: RPN2
  Gene Name: ribophorin II
  ENSP ID: ENSP00000435563
MQRKHVPTSDLTLIPAMWIPSSTLPRPARPSQDVRTVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAI

SEQ ID NO: 73892 - protein, 311 aa, Homo sapiens
  Payload ID: 14620
  Gene Symbol: RPIA
  Gene Name: ribose 5-phosphate isomerase A
  Uniprot ID: P49247
  ENSP ID: ENSP00000283646
MQRPGPFSTLYGRVLAPLPGRAGGAASGGGGNSWDLPGSHVRLPGRAQSGTRGGAGNTSTSCGDSNSICPAPSTMSKAEEAKKLAGRAAVENHVRNNQVLGIGSGSTIVHAVQRIAERVKQENLNLVCIPTSFQARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGVVDTGLFINMAERVYFGMQDGSVNMREKPFC

SEQ ID NO: 73893 - protein, 430 aa, Homo sapiens
  Payload ID: 14621
  Gene Symbol: RSL1D1
  Gene Name: ribosomal L1 domain containing 1
  ENSP ID: ENSP00000347897
MEDSASASLSSAAATGTSTSTPAAPTARKQLDKEQVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLLSKNLSREINDCIGGTVLNISKSGSCSAIRIGHVGMQIEHIIENIVAVTKGLSEKLPEWESVKLLFVKTEKSAALPIFSSFVSNWDEATKRSLLNKKKKEARRKRRERNFEKQKERKKKRQQARKTASVLSKDDVAPESGDTTVKKPESKKEQTPEHGKKKRGRGKAQVKATNESEDEIPQLVPIGKKTPANEKVEIQKHATGKKSPAKSPNPSTPRGKKRKALPASETPKAAESETPGKSPEKK

SEQ ID NO: 73894 - protein, 39 aa, Homo sapiens
  Payload ID: 14621
  Gene Symbol: RSL1D1
  Gene Name: ribosomal L1 domain containing 1
  ENSP ID: ENSP00000379760
MEDSASASLSSAAATGTSTSTPAAPTARKQLDKEQDLAS

SEQ ID NO: 73895 - protein, 93 aa, Homo sapiens
  Payload ID: 14621
  Gene Symbol: RSL1D1
  Gene Name: ribosomal L1 domain containing 1
  ENSP ID: ENSP00000458684
  MOD_RES (1)..(1): Any amino acid
XDSASASLSSAAATGTSTSTPAAPTARKQLDKEQVRKAVDALLTHCKSRKNNYGLLLNENESLFLMVVLWKIPSKELRVRLDEILRCCPAGVQ

SEQ ID NO: 73896 - protein, 47 aa, Homo sapiens
  Payload ID: 14621
  Gene Symbol: RSL1D1
  Gene Name: ribosomal L1 domain containing 1
  ENSP ID: ENSP00000459207
MEDSASASLSSAAATGTSTSTPAAPTARKQLDKEQDFQKNCQRSGRA

SEQ ID NO: 73897 - protein, 98 aa, Homo sapiens
  Payload ID: 14621
  Gene Symbol: RSL1D1
  Gene Name: ribosomal L1 domain containing 1
  ENSP ID: ENSP00000459331
MVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRL

SEQ ID NO: 73898 - protein, 43 aa, Homo sapiens
  Payload ID: 14621
  Gene Symbol: RSL1D1
  Gene Name: ribosomal L1 domain containing 1
  ENSP ID: ENSP00000459622
MEDSASASLSSAAATGTSTSTPAAPTARKQLDKEQVKRQWTLS

SEQ ID NO: 73899 - protein, 158 aa, Homo sapiens
  Payload ID: 14621
  Gene Symbol: RSL1D1
  Gene Name: ribosomal L1 domain containing 1
  ENSP ID: ENSP00000460343
MVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLLSKNLSR

SEQ ID NO: 73900 - protein, 296 aa, Homo sapiens
  Payload ID: 14621
  Gene Symbol: RSL1D1
  Gene Name: ribosomal L1 domain containing 1
  ENSP ID: ENSP00000460748
MEDSASASLSSAAATGTSTSTPAAPTARKQLDKEQVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKNAIRIGHVGMQIEHIIENIVAVTKGLSEKLPEKWESVKLLFVKTEKSAALPIFSSFVSNWDEATKRSLLNKKKKEARRKRRERNFEKQKERKKKRQQARKTASVLSKDDVAPESGDTTV

SEQ ID NO: 73901 - protein, 490 aa, Homo sapiens
  Payload ID: 14621
  Gene Symbol: RSL1D1
  Gene Name: ribosomal L1 domain containing 1
  Uniprot ID: O76021
  ENSP ID: ENSP00000460871
MEDSASASLSSAAATGTSTSTPAAPTARKQLDKEQVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLLSKNLSREINDCIGGTVLNISKSGSCSAIRIGHVGMQIEHIIENIVAVTKGLSEKLPEKWESVKLLFVKTEKSAALPIFSSFVSNWDEATKRSLLNKKKKEARRKRRERNFEKQKERKKKRQQARKTASVLSKDDVAPESGDTTVKKPESKKEQTPEHGKKKRGRGKAQVKATNESEDEIPQLVPIGKKTPANEKVEIQKHATGKKSPAKSPNPSTPRGKKRKALPASETPKAAESETPGKSPEKKPKIKEEAVKEKSPSLGKKDARQTPKKPEAKFFTTPSKSVRKASHTPKKWPKKPKVPQST

SEQ ID NO: 73902 - protein, 46 aa, Homo sapiens
  Payload ID: 14621
  Gene Symbol: RSL1D1
  Gene Name: ribosomal L1 domain containing 1
  ENSP ID: ENSP00000461513
MEDSASASLSSAAATGTSTSTPAAPTARKQLDKEQCYTYWSRWNAN

SEQ ID NO: 73903 - protein, 163 aa, Homo sapiens
  Payload ID: 14622
  Gene Symbol: RSL24D1
  Gene Name: ribosomal L24 domain containing 1
  Uniprot ID: Q9UHA3
  ENSP ID: ENSP00000260443
MRIEKCYFCSGPIYPGHGMMFVRNDCKVFRFCKSKCHKNFKKKRNPRKVRWTKAFRKAAGKELTVDNSFEFEKRRNEPIKYQRELWNKTIDAMKRVEEIKQKRQAKFIMNRLKKNKELQKVQDIKEVKQNIHLIRAPLAGKGKQLEEKMVQQLQEDVDMEDAP

SEQ ID NO: 73904 - protein, 66 aa, Homo sapiens
  Payload ID: 14622
  Gene Symbol: RSL24D1
  Gene Name: ribosomal L24 domain containing 1
  ENSP ID: ENSP00000454492
MVELCIKLLQVFRFCKSKCHKNFKKKRNPRKVRWTKAFRKAAGKELTVDNSFEFEKRRNEPIKYQR

SEQ ID NO: 73905 - protein, 83 aa, Homo sapiens
  Payload ID: 14622
  Gene Symbol: RSL24D1
  Gene Name: ribosomal L24 domain containing 1
  ENSP ID: ENSP00000455291
MRIEKCYFCSGPIYPGHGMMFVRNDCKVFRFCKSKCHKNFKKKRNPRKVRWTKAFRKAAGKELTVVSTVSYQYSFYTFHSFSI

SEQ ID NO: 73906 - protein, 97 aa, Homo sapiens
  Payload ID: 14623
  Gene Symbol: RIMKLA
  Gene Name: ribosomal modification protein rimK-like family member A
  ENSP ID: ENSP00000387064
MPDTFSYGGHEDFSKMIDEAEPLGYPVVVKSTRGHRGKAVFLARDKHHLSDICHLIRHDVPYLFQKYVKESHGKDIRVVVVGGQVIGSMLRCSTDGR

SEQ ID NO: 73907 - protein, 391 aa, Homo sapiens
  Payload ID: 14623
  Gene Symbol: RIMKLA
  Gene Name: ribosomal modification protein rimK-like family member A
  Uniprot ID: Q8IXN7
  ENSP ID: ENSP00000414330
MCSQLWFLTDRRIREDYPQVQILRALRQRCSEQDVRFRAVLMDQIAVTIVGGHLGLQLNQKALTTFPDVVLVRVPTPSVQSDSDITVLRHLEKLGCRLVNRPQSILNCINKFWTFQELAGHGVPMPDTFSYGGHEDFSKMIDEAEPLGYPVVVKSTRGHRGKAVFLARDKHHLSDICHLIRHDVPYLFQKYVKESHGKDIRVVVVGGQVIGSMLRCSTDGRMQSNCSLGGVGVKCPLTEQGKQLAIQVSNILGMDFCGIDLLIMDDGSFVVCEANANVGFLAFDQACNLDVGGIIADYTMSLLPNRQTGKMAVLPGLSSPREKNEPDGCASAQGVAESVYTINSGSTSSESEPELGEIRDSSASTMGAPPSMLPEPGYNINNRIASELKLK

SEQ ID NO: 73908 - protein, 386 aa, Homo sapiens
  Payload ID: 14624
  Gene Symbol: RIMKLB
  Gene Name: ribosomal modification protein rimK-like family member B
  Uniprot ID: Q9ULI2
  ENSP ID: ENSP00000350136
MCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAILNCVNKFWTFQELAGHGVPLPDTFSYGGHENFAKMIDEAEVLEFPMVVKNTRGHRGKAVFLARDKHHLADLSHLIRHEAPYLFQKYVKESHGRDVRVIVVGGRVVGTMLRCSTDGRMQSNCSLGGVGMMCSLSEQGKQLAIQVSNILGMDVCGIDLLMKDDGSFCVCEANANVGFIAFDKACNLDVAGIIADYAASLLPSGRLTRRMSLLSVVSTASETSEPELGPPASTAVDNMSASSSSVDSDPESTERELLTKLPGGLFNMNQLLANEIKLLVD

SEQ ID NO: 73909 - protein, 307 aa, Homo sapiens
  Payload ID: 14624
  Gene Symbol: RIMKLB
  Gene Name: ribosomal modification protein rimK-like family member B
  Uniprot ID: Q9ULI2
  ENSP ID: ENSP00000438004
MCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAILNCVNKFWTFQELAGHGVPLPDTFSYGGHENFAKMIDEAEVLEFPMVVKNTRGHRGKAVFLARDKHHLADLSHLIRHEAPYLFQKYVKESHGRDVRVIVVGGRVVGTMLRCSTDGRMQSNCSLGGVGMMCSLSEQGKQLAIQVSNILGMDVCGIDLLMKDDGSFCVCEANANPFQEPKKQIQTNKKIPREKTFLLPPS

SEQ ID NO: 73910 - protein, 95 aa, Homo sapiens
  Payload ID: 14624
  Gene Symbol: RIMKLB
  Gene Name: ribosomal modification protein rimK-like family member B
  ENSP ID: ENSP00000439079
MCSSVAAKLWFLTDRRIREDYPQKEILRALKAKCCEEELDFRAVVMDEVVLTIEQGNLGLRINGELITAYPQVVVVRVPTPWVQSDSDITVLRHL

SEQ ID NO: 73911 - protein, 386 aa, Homo sapiens; identical to SEQ ID NO: 73908
  Payload ID: 14624
  Gene Symbol: RIMKLB
  Gene Name: ribosomal modification protein rimK-like family member B
  Uniprot ID: Q9ULI2
  ENSP ID: ENSP00000440943

SEQ ID NO: 73912 - protein, 114 aa, Homo sapiens
  Payload ID: 14624
  Gene Symbol: RIMKLB
  Gene Name: ribosomal modification protein rimK-like family member B
  ENSP ID: ENSP00000444445
MCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAILNCVN

SEQ ID NO: 73913 - protein, 170 aa, Homo sapiens
  Payload ID: 14624
  Gene Symbol: RIMKLB
  Gene Name: ribosomal modification protein rimK-like family member B
  ENSP ID: ENSP00000444721
MARVRARSWEGGSRRSRPAARASSKAPARLSRPRAREEPPDPGRRYIQEEIIQARKHKLIKMCSSVAAKLWFLTDRRIREDYPQKEILRALKAKCCEEELDFRAVVMDEVVLTIEQGNLGLRINGELITAYPQVVVVRVPTPWVQSDSDITVLRHLEKMGCRLMNRPQAI

SEQ ID NO: 73914 - protein, 386 aa, Homo sapiens; identical to SEQ ID NO: 73908
  Payload ID: 14624
  Gene Symbol: RIMKLB
  Gene Name: ribosomal modification protein rimK-like family member B
  Uniprot ID: Q9ULI2
  ENSP ID: ENSP00000445863

SEQ ID NO: 73915 - protein, 307 aa, Homo sapiens; identical to SEQ ID NO: 73909
  Payload ID: 14624
  Gene Symbol: RIMKLB
  Gene Name: ribosomal modification protein rimK-like family member B
  Uniprot ID: Q9ULI2
  ENSP ID: ENSP00000483871

SEQ ID NO: 73916 - protein, 214 aa, Homo sapiens
  Payload ID: 14625
  Gene Symbol: RPL10
  Gene Name: ribosomal protein L10
  Uniprot ID: P27635
  ENSP ID: ENSP00000341730
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 73917 - protein, 214 aa, Homo sapiens; identical to SEQ ID NO: 73916
  Payload ID: 14625
  Gene Symbol: RPL10
  Gene Name: ribosomal protein L10
  Uniprot ID: P27635
  ENSP ID: ENSP00000358832

SEQ ID NO: 73918 - protein, 163 aa, Homo sapiens
  Payload ID: 14625
  Gene Symbol: RPL10
  Gene Name: ribosomal protein L10
  ENSP ID: ENSP00000385621
MVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 73919 - protein, 200 aa, Homo sapiens
  Payload ID: 14625
  Gene Symbol: RPL10
  Gene Name: ribosomal protein L10
  ENSP ID: ENSP00000388600
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYI

SEQ ID NO: 73920 - protein, 181 aa, Homo sapiens
  Payload ID: 14625
  Gene Symbol: RPL10
  Gene Name: ribosomal protein L10
  ENSP ID: ENSP00000395025
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRSTSQRSGASPSSMLMNLKTWWLKSGSSQMAVGSSTSPVVALWTSGGPCTHEGFQCAAPLLILTNKFYFLST

SEQ ID NO: 73921 - protein, 91 aa, Homo sapiens
  Payload ID: 14625
  Gene Symbol: RPL10
  Gene Name: ribosomal protein L10
  ENSP ID: ENSP00000398047
LHPFHVIRINKMLSCAGADRLQTGMRGAFGKPQGTVARVHIGQVIMSIRTKLQNKEHVIEALRRAKFKFPGRQKGAPIPAQTSLSPSLPHP

SEQ ID NO: 73922 - protein, 131 aa, Homo sapiens
  Payload ID: 14625
  Gene Symbol: RPL10
  Gene Name: ribosomal protein L10
  ENSP ID: ENSP00000405064
LHPFHVIRINKMLSCAGADRLQTGMRGAFGKPQGTVARVHIGQVIMSIRTKLQNKEHVIEALRRAKFKFPGRQKAYLALPVLGDLQKHIVEGVQLLLYGLRSGVQRDQHQAGKDCKAQGPRAAIHSWTFSP

SEQ ID NO: 73923 - protein, 108 aa, Homo sapiens
  Payload ID: 14625
  Gene Symbol: RPL10
  Gene Name: ribosomal protein L10
  ENSP ID: ENSP00000406125
PKSRFCRGVPDAKIRIFDLGRKKAKVDEFPLCGHMVSDEYEQLSSEALEAARICANKYMVKSCGKDGFHIRVRLHPFHVIRINKMLSCAGADRPTLLCQCWETSRNTS

SEQ ID NO: 73924 - protein, 28 aa, Homo sapiens
  Payload ID: 14625
  Gene Symbol: RPL10
  Gene Name: ribosomal protein L10
  ENSP ID: ENSP00000407754
LHPFHVIRINKMLSCAGADSPIPSPPPR

SEQ ID NO: 73925 - protein, 214 aa, Homo sapiens; identical to SEQ ID NO: 73916
  Payload ID: 14625
  Gene Symbol: RPL10
  Gene Name: ribosomal protein L10
  Uniprot ID: P27635
  ENSP ID: ENSP00000413436

SEQ ID NO: 73926 - protein, 178 aa, Homo sapiens
  Payload ID: 14625
  Gene Symbol: RPL10
  Gene Name: ribosomal protein L10
  ENSP ID: ENSP00000479103
MGRRPARCYRYCKNKPYPKSRFCRGVPALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 73927 - protein, 217 aa, Homo sapiens
  Payload ID: 14626
  Gene Symbol: RPL10A
  Gene Name: ribosomal protein L10a
  Uniprot ID: P62906
  ENSP ID: ENSP00000363018
MSSKVSRDTLYEAVREVLHGNQRKRRKFLETVELQISLKNYDPQKDKRFSGTVRLKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 73928 - protein, 214 aa, Homo sapiens [sequence omitted]

SEQ ID NO: 73929 - protein, 178 aa, Homo sapiens [sequence omitted]

SEQ ID NO: 73930 - protein, 131 aa, Homo sapiens
  Payload ID: 14628
  Gene Symbol: RPL11
  Gene Name: ribosomal protein L11
  ENSP ID: ENSP00000390839
QDQGEKENPMRELRIRKLCLNICVGESGDRLTRAAKVLEQLTGQTPVFSKARYTVRSFGIRRNEKIAVHCTVRGAKAEEILEKGLKVREYELRKNNFSDTGNFGFGIQEHIDLGIKYDPSIGIYGLDFYVV

SEQ ID NO: 73931 - protein, 174 aa, Homo sapiens
  Payload ID: 14628
  Gene Symbol: RPL11
  Gene Name: ribosomal protein L11
  ENSP ID: ENSP00000398888
QDQGEKENPMRELRIRKLCLNICVGESGDRLTRAAKVLEQLTGQTPVFSKARYTVRSFGIRRNEKIAVHCTVRGAKAEEILEKGLKVREYELRKNNFSDTGNFGFGIQEHIDLGIKYDPSIGIYGLDFYVVLGRPGFSIADKKRRTGCIGAKHRISKEEAMRWFQQKVKLIYLK

SEQ ID NO: 73932 - protein, 165 aa, Homo sapiens [sequence omitted]

SEQ ID NO: 73933 - protein, 132 aa, Homo sapiens
  Payload ID: 14629
  Gene Symbol: RPL12
  Gene Name: ribosomal protein L12
  Uniprot ID: P30050
  ENSP ID: ENSP00000441179
MPPKFDPNEIKVVYLRCTGGEVGATSALAPKIGPLGLIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 73934 - protein, 211 aa, Homo sapiens [sequence omitted]

SEQ ID NO: 73935 - protein, 211 aa, Homo sapiens [sequence omitted]

SEQ ID NO: 73936 - protein, 164 aa, Homo sapiens
  Payload ID: 14630
  Gene Symbol: RPL13
  Gene Name: ribosomal protein L13
  Uniprot ID: P26373
  ENSP ID: ENSP00000438959
MAPSRNGMVLKPHFHKDWQRRVATWFNQPARKIRRRKARQAKARRIAPRPASGPIRPIVRCPTVRYHTKVRAGRGFSLEELRVAGIHKKGDSSAEELKLATQLTGPVMPVRNVYKKEKARVITEEEKNFKAFASLRMARANARLFGIRAKRAKEAAEQDVEKKK

SEQ ID NO: 73937 - protein, 211 aa, Homo sapiens [sequence omitted]

SEQ ID NO: 73938 - protein, 63 aa, Homo sapiens
  Payload ID: 14630
  Gene Symbol: RPL13
  Gene Name: ribosomal protein L13
  ENSP ID: ENSP00000457174
MAPSRNGMVLKPHFHKDWQRRVATWFNQPARKIRRRWPGPSAFLWIRGGGTSPRSPCRPTCSG

SEQ ID NO: 73939 - protein, 54 aa, Homo sapiens
  Payload ID: 14630
  Gene Symbol: RPL13
  Gene Name: ribosomal protein L13
  ENSP ID: ENSP00000457686
MPVRNVYKKEKARVITEEEKNFKAFASLRMARANARLFGIRAKRAKEAAEQDVE

SEQ ID NO: 73940 - protein, 78 aa, Homo sapiens
  Payload ID: 14630
  Gene Symbol: RPL13
  Gene Name: ribosomal protein L13
  ENSP ID: ENSP00000462380
  MOD_RES (1)..(1): Any amino acid
XPVMPVRNVSEHLLKSRLQTRSVGEHVYKKEKARVITEEEKNFKAFASLRMARANARLFGIRAKRAKEAAEQDVEKKK

SEQ ID NO: 73941 - protein, 126 aa, Homo sapiens
  Payload ID: 14630
  Gene Symbol: RPL13
  Gene Name: ribosomal protein L13
  ENSP ID: ENSP00000464612
MAPSRNGMVLKPHFHKDWQRRVATWFNQPARKIRRRKARQAKARRIAPRPASGPIRPIVRCPTVRYHTKVRAGRGFSLEELRVAGIHKKVARTIGISVDPRRRNKSTESLQANVQRLKEYRSKLIL

SEQ ID NO: 73942 - protein, 203 aa, Homo sapiens [sequence omitted]

SEQ ID NO: 73943 - protein, 210 aa, Homo sapiens
  Payload ID: 14631
  Gene Symbol: RPL13A
  Gene Name: ribosomal protein L13a
  ENSP ID: ENSP00000470037
  MOD_RES (1)..(1): Any amino acid
XEVQVLVLDGRGHLLGRLAAIVAKQVLLGRKVVVVRCEGINISGNFYRNKLKYLAFLRKRMNTNPSRGPYHFRAPSRIFWRTVRGEQSVGTAGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 73944 - protein, 46 aa, Homo sapiens
  Payload ID: 14631
  Gene Symbol: RPL13A
  Gene Name: ribosomal protein L13a
  ENSP ID: ENSP00000470768
MAEVQVLVLDGRGHLLGRLAAIVAKQVLLGKSLLVAPLSWAPAGGQ

SEQ ID NO: 73945 - protein, 142 aa, Homo sapiens
  Payload ID: 14631
  Gene Symbol: RPL13A
  Gene Name: ribosomal protein L13a
  ENSP ID: ENSP00000477755
MNTNPSRGPYHFRAPSRIFWRTVRGMLPHKTKRGQAALDRLKVFDGIPPPYDKKKRMVVPAALKVVRLKPTRKFAYLGRLAHEVGWKYQAVTATLEEKRKEKAKIHYRKKKQLMRLRKQAEKNVEKKIDKYTEVLKTHGLLV

SEQ ID NO: 73946 - protein, 48 aa, Homo sapiens
  Payload ID: 14631
  Gene Symbol: RPL13A
  Gene Name: ribosomal protein L13a
  ENSP ID: ENSP00000485546
MAEVQVLVLDGRGHLLGRLAAIVAKQAGRWWSYAVKASTFLAISTETS

SEQ ID NO: 73947 - protein, 215 aa, Homo sapiens [sequence omitted]

SEQ ID NO: 73948 - protein, 215 aa, Homo sapiens [sequence omitted]

SEQ ID NO: 73949 - protein, 124 aa, Homo sapiens
  Payload ID: 14632
  Gene Symbol: RPL14
  Gene Name: ribosomal protein L14
  ENSP ID: ENSP00000391446
MVFRRFVEVGRVAYVSFGPHAGKLVAIVDVIDQNRALVDGPCTQVRRQAMPFKCMQLTDFILKFPHSAHQKYVRQAWQKADINTKWAATRWAKKIEARERKAKMTDFDRFKVMKAKKMEQNNQE

SEQ ID NO: 73950 - protein, 52 aa, Homo sapiens
  Payload ID: 14632
  Gene Symbol: RPL14
  Gene Name: ribosomal protein L14
  ENSP ID: ENSP00000402476
MVRVPGPAVQRNRALPGLAPFPDSPLASAWRARQAWRALGHACAPPPLELDG

SEQ ID NO: 73951 - protein, 204 aa, Homo sapiens [sequence omitted]

SEQ ID NO: 73952 - protein, 204 aa, Homo sapiens [sequence omitted]

SEQ ID NO: 73953 - protein, 133 aa, Homo sapiens
  Payload ID: 14633
  Gene Symbol: RPL15
  Gene Name: ribosomal protein L15
  ENSP ID: ENSP00000387925
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVI

SEQ ID NO: 73954 - protein, 204 aa, Homo sapiens [sequence omitted]

SEQ ID NO: 73955 - protein, 204 aa, Homo sapiens [sequence omitted]

SEQ ID NO: 73956 - protein, 145 aa, Homo sapiens
  Payload ID: 14633
  Gene Symbol: RPL15
  Gene Name: ribosomal protein L15
  Uniprot ID: P61313
  ENSP ID: ENSP00000398788
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWMESHSHSGGSAVGQSRLTATSVSRV

SEQ ID NO: 73957 - protein, 174 aa, Homo sapiens
  Payload ID: 14633
  Gene Symbol: RPL15
  Gene Name: ribosomal protein L15
  ENSP ID: ENSP00000405590
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEERAGRHCGALRVLNSYWVGEDSTYKFFEVILIDPFHKAIRRNPDTQWITKPVHKHREMRGLTSAGRKSRGL

SEQ ID NO: 73958 - protein, 59 aa, Homo sapiens
  Payload ID: 14633
  Gene Symbol: RPL15
  Gene Name: ribosomal protein L15
  ENSP ID: ENSP00000408243
MGAYKYIQELWRKKQSDVMRFLLRVRCWQYRQLSALHRAPRPTRPDKARRLGYKAKQGT

SEQ ID NO: 73959 - protein, 175 aa, Homo sapiens
  Payload ID: 14633
  Gene Symbol: RPL15
  Gene Name: ribosomal protein L15
  ENSP ID: ENSP00000411176
MGAYKYIQELWRKKQSDVMRFLLRVRCWQYRQLSALHRAPRPTRPDKARRLGYKAKQGYVIYRIRVRRGGRKRPVPKGATYGKPVHHGVNQLKFARSLQSVAEVNAGRHCGALRVLNSYWVGEDSTYKFFEVILIDPFHKAIRRNPDTQWITKPVHKHREMRGLTSAGRKSRGLG

SEQ ID NO: 73960 - protein, 204 aa, Homo sapiens [sequence omitted]

SEQ ID NO: 73961 - protein, 204 aa, Homo sapiens [sequence omitted]

SEQ ID NO: 73962 - protein, 129 aa, Homo sapiens
  Payload ID: 14634
  Gene Symbol: RPL17
  Gene Name: ribosomal protein L17
  ENSP ID: ENSP00000461910
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRT

SEQ ID NO: 73963 - protein, 184 aa, Homo sapiens [sequence omitted]

SEQ ID NO: 73964 - protein, 174 aa, Homo sapiens
  Payload ID: 14634
  Gene Symbol: RPL17
  Gene Name: ribosomal protein L17
  ENSP ID: ENSP00000462203
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKK

SEQ ID NO: 73965 - protein, 184 aa, Homo sapiens [sequence omitted]

SEQ ID NO: 73966 - protein, 56 aa, Homo sapiens
  Payload ID: 14634
  Gene Symbol: RPL17
  Gene Name: ribosomal protein L17
  ENSP ID: ENSP00000462508
MVRYSLDPENPTKSCKSRGSNLRVHFKNTRETAQAIKGMHIRKATKYLKDVTLQKQ

SEQ ID NO: 73967 - protein, 146 aa, Homo sapiens
  Payload ID: 14634
  Gene Symbol: RPL17
  Gene Name: ribosomal protein L17
  Uniprot ID: P18621
  ENSP ID: ENSP00000462944
MHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARE

SEQ ID NO: 73968 - protein, 174 aa, Homo sapiens
  Payload ID: 14634
  Gene Symbol: RPL17
  Gene Name: ribosomal protein L17
  ENSP ID: ENSP00000463490
MSYSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARE

SEQ ID NO: 73969 - protein, 184 aa, Homo sapiens [sequence omitted]

SEQ ID NO: 73970 - protein, 171 aa, Homo sapiens
  Payload ID: 14634
  Gene Symbol: RPL17
  Gene Name: ribosomal protein L17
  ENSP ID: ENSP00000463885
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKIS

SEQ ID NO: 73971 - protein, 138 aa, Homo sapiens
  Payload ID: 14634
  Gene Symbol: RPL17
  Gene Name: ribosomal protein L17
  ENSP ID: ENSP00000464586
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINP

SEQ ID NO: 73972 - protein, 131 aa, Homo sapiens
  Payload ID: 14634
  Gene Symbol: RPL17
  Gene Name: ribosomal protein L17
  ENSP ID: ENSP00000480215
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYR

SEQ ID NO: 73973 - protein, 184 aa, Homo sapiens [sequence omitted]

SEQ ID NO: 73974 - protein, 169 aa, Homo sapiens
  Payload ID: 14634
  Gene Symbol: RPL17
  Gene Name: ribosomal protein L17
  ENSP ID: ENSP00000481145
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKK

SEQ ID NO: 73975 - protein, 97 aa, Homo sapiens
  Payload ID: 14634
  Gene Symbol: RPL17
  Gene Name: ribosomal protein L17
  ENSP ID: ENSP00000481587
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKN

SEQ ID NO: 73976 - protein, 184 aa, Homo sapiens [sequence omitted]

SEQ ID NO: 73977 - protein, 190 aa, Homo sapiens
  Payload ID: 14635
  Gene Symbol: RPL18
  Gene Name: ribosomal protein L18
  ENSP ID: ENSP00000084795
  MOD_RES (1)..(1): Any amino acid
XPQGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTKPYVRSKGRKFERARGRRASRGYKN

SEQ ID NO: 73978 - protein, 167 aa, Homo sapiens
  Payload ID: 14635
  Gene Symbol: RPL18
  Gene Name: ribosomal protein L18
  ENSP ID: ENSP00000446634
  MOD_RES (1)..(1): Any amino acid
XVKLYRFLARRTNSTFNQVVLKRLFMSRTNRPPLSLSRMIRKMKLPGRENKTAVVVGTITDDVRVQEVPKLKPCPLHQVCALRVTSRARSRILRAGGKILTFDQLALDSPKGCGTVLLSGPRKGREVYRHFGKAPGTPHSHTKPYVRSKGRKFERARGRRASRGYKN

SEQ ID NO: 73979 - protein, 188 aa, Homo sapiens [sequence omitted]

SEQ ID NO: 73980 - protein, 130 aa, Homo sapiens
  Payload ID: 14635
  Gene Symbol: RPL18
  Gene Name: ribosomal protein L18
  ENSP ID: ENSP00000447894
MSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTKPYVRSKGRKFERARGRRA

SEQ ID NO: 73981 - protein, 133 aa, Homo sapiens
  Payload ID: 14635
  Gene Symbol: RPL18
  Gene Name: ribosomal protein L18
  ENSP ID: ENSP00000448899
MGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKAPGTPHSHTKPYVRSKGRKFERARGRRASRGYKN

SEQ ID NO: 73982 - protein, 84 aa, Homo sapiens
  Payload ID: 14635
  Gene Symbol: RPL18
  Gene Name: ribosomal protein L18
  ENSP ID: ENSP00000449067
MGVDIRHNKDRKVRRKEPKSQDIYLRLLVKVSGQKNQLHIQPGCVEEVVYESHQPAASVPFPDDPEDEASWPGKQDGRGCGDHN

SEQ ID NO: 73983 - protein, 159 aa, Homo sapiens
  Payload ID: 14635
  Gene Symbol: RPL18
  Gene Name: ribosomal protein L18
  Uniprot ID: Q07020
  ENSP ID: ENSP00000449204
MLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTKPYVRSKGRKFERARGRRASRGYKN

SEQ ID NO: 73984 - protein, 164 aa, Homo sapiens
  Payload ID: 14635
  Gene Symbol: RPL18
  Gene Name: ribosomal protein L18
  ENSP ID: ENSP00000449610
MGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTK

SEQ ID NO: 73985 - protein, 138 aa, Homo sapiens
  Payload ID: 14635
  Gene Symbol: RPL18
  Gene Name: ribosomal protein L18
  ENSP ID: ENSP00000470988
MGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKTLRPLQGPEVRACQRPTGQPRLQKLTLDPTLLLKRFLLT

SEQ ID NO: 73986 - protein, 176 aa, Homo sapiens [sequence omitted]

SEQ ID NO: 73987 - protein, 137 aa, Homo sapiens
  Payload ID: 14636
  Gene Symbol: RPL18A
  Gene Name: ribosomal protein L18a
  ENSP ID: ENSP00000471360
MKASGTLREYKLKKMKKSSGEIVYCGQVFEKSPLRVKNFGIWLRYDSRSGTHNMYREYRDLTTAGAVTQCYRDMGARHRARAHSIQIMKVEEIAASKCRRPAVKQFHDSKIKFPLPHRVLRRQHKPRFTTKRPNTFF

SEQ ID NO: 73988 - protein, 154 aa, Homo sapiens
  Payload ID: 14636
  Gene Symbol: RPL18A
  Gene Name: ribosomal protein L18a
  ENSP ID: ENSP00000471584
MKASGTLREYKVVGRCLPTPKCHTPPLYRMRIFAPNHVVAKSRFWYFVSQLKKMKKSSGEIVYCGQVFEKSPLRVKNFGIWLRYDSRSGTHNMYREYRDLTTAGAVTQCYRDMGARHRARAHSIQIMKVEEIAASKCRRPHKPRFTTKRPNTFF

SEQ ID NO: 73989 - protein, 147 aa, Homo sapiens
  Payload ID: 14636
  Gene Symbol: RPL18A
  Gene Name: ribosomal protein L18a
  ENSP ID: ENSP00000471748
MRIFAPNHVVAKSRFWYFVSQLKKMKKSSGEIVYCGQVFEKSPLRVKNFGIWLRYDSRSGTHNMYREYRDLTTAGAVTQCYRDMGARHRARAHSIQIMKVEEIAASKCRRPAVKQFHDSKIKFPLPHRVLRRQHKPRFTTKRPNTFF

SEQ ID NO: 73990 - protein, 141 aa, Homo sapiens
  Payload ID: 14636
  Gene Symbol: RPL18A
  Gene Name: ribosomal protein L18a
  ENSP ID: ENSP00000473155
MRIFAPNHVVAKSRFWYFVSQLKKMKKSSGEIVYCGQVFEKSPLRVKNFGIWLRYDSRSGTHNMYREYRDLTTAGAVTQCYRDMGARHRARAHSIQIMKVEEIAASKCRRPAVKQFHDSKIKFPLPHRVLRRQHKPRFTTK

SEQ ID NO: 73991 - protein, 196 aa, Homo sapiens [sequence omitted]

SEQ ID NO: 73992 - protein, 194 aa, Homo sapiens
  Payload ID: 14637
  Gene Symbol: RPL19
  Gene Name: ribosomal protein L19
  ENSP ID: ENSP00000462938
MLRLQKRLASSVLRCGKKKVWLDPNETNEIANANSRQQIRKLIKDGLIIRKPVTVHSRARCRKNTLARRKGRHMGIGKRKGTANARMPEKVTWMRRMRILRRLLRRYRESKKIDRHMYHSLYLKVKGNVFKNKRILMEHIHKLKADKARKKLLADQAEARRSKTKEARKRREERLQAKKEEIIKTLSKEEETKK

SEQ ID NO: 73993 - protein, 128 aa, Homo sapiens
  Payload ID: 14637
  Gene Symbol: RPL19
  Gene Name: ribosomal protein L19
  ENSP ID: ENSP00000463329
MGTFILAQDWLSESNHVFCVSSMLRLQKRLASSVLRCGKKKVWLDPNETNEIANANSRQQIRKLIKDGLIIRKPVTVHSRARCRKNTLARRKGRHMGIGKRKGTANARMPEKVTWMRRMRILRRLLRR

SEQ ID NO: 73994 - protein, 193 aa, Homo sapiens
  Payload ID: 14637
  Gene Symbol: RPL19
  Gene Name: ribosomal protein L19
  ENSP ID: ENSP00000463985
MRLQKRLASSVLRCGKKKVWLDPNETNEIANANSRQQIRKLIKDGLIIRKPVTVHSRARCRKNTLARRKGRHMGIGKRKGTANARMPEKVTWMRRMRILRRLLRRYRESKKIDRHMYHSLYLKVKGNVFKNKRILMEHIHKLKADKARKKLLADQAEARRSKTKEARKRREERLQAKKEEIIKTLSKEEETKK

SEQ ID NO: 73995 - protein, 194 aa, Homo sapiens; identical to SEQ ID NO: 73992
  Payload ID: 14637
  Gene Symbol: RPL19
  Gene Name: ribosomal protein L19
  ENSP ID: ENSP00000464538

SEQ ID NO: 73996 - protein, 160 aa, Homo sapiens [sequence omitted]

SEQ ID NO: 73997 - protein, 160 aa, Homo sapiens [sequence omitted]

SEQ ID NO: 73998 - protein, 160 aa, Homo sapiens [sequence omitted]

SEQ ID NO: 73999 - protein, 160 aa, Homo sapiens [sequence omitted]

SEQ ID NO: 74000 - protein, 87 aa, Homo sapiens
  Payload ID: 14638
  Gene Symbol: RPL21
  Gene Name: ribosomal protein L21
  ENSP ID: ENSP00000434298
MTNTKGKRRGTRYMFSRPFRKHGVVPLATYMRIYKKGDIVDIKGMGTVQKGMPHKCYHGKTGRVYNVTQHAVGIVVNKQGQDSCQEN

SEQ ID NO: 74001 - protein, 122 aa, Homo sapiens
  Payload ID: 14638
  Gene Symbol: RPL21
  Gene Name: ribosomal protein L21
  ENSP ID: ENSP00000471695
MTNTKGKRRGTRYMFSRPFRKHGVVPLATYMRIYKKGDIVDIKGMGTVQKGMPHKCYHGKTGRVYNVTQHAVGIVVNKQVKGKILAKRINVRIEHIKHSKSRDSFLKRVKENDQKKKEAKEK

SEQ ID NO: 74002 - protein, 59 aa, Homo sapiens
  Payload ID: 14638
  Gene Symbol: RPL21
  Gene Name: ribosomal protein L21
  ENSP ID: ENSP00000473246
MTNTKGKRRGTRYMFSRPFRKHGNGYCSKRNAPQVLPWQNWKSLQCYPACCWHCCKQTS

SEQ ID NO: 74003 - protein, 128 aa, Homo sapiens [sequence omitted]

SEQ ID NO: 74004 - protein, 47 aa, Homo sapiens
  Payload ID: 14639
  Gene Symbol: RPL22
  Gene Name: ribosomal protein L22
  ENSP ID: ENSP00000465313
MDAANFEQFLQERIKVNGKAGNLGGGVVTIERSKSKITVTSEVPFSK

SEQ ID NO: 74005 - protein, 53 aa, Homo sapiens
  Payload ID: 14639
  Gene Symbol: RPL22
  Gene Name: ribosomal protein L22
  ENSP ID: ENSP00000465763
MDAANFEQFLQERIKVNGKAGNLGGGVVTIERSKSKITVTSEVPFSKRRPALG

SEQ ID NO: 74006 - protein, 79 aa, Homo sapiens
  Payload ID: 14639
  Gene Symbol: RPL22
  Gene Name: ribosomal protein L22
  ENSP ID: ENSP00000466013
MDAANFEQFLQERIKVNGKAGNLGGGVVTIERSKSKITVTSEVPFSKRYLKYLTKKYLKKNNLRDWLRVVANSKESYEL

SEQ ID NO: 74007 - protein, 89 aa, Homo sapiens
  Payload ID: 14639
  Gene Symbol: RPL22
  Gene Name: ribosomal protein L22
  ENSP ID: ENSP00000466502
MDAANFEQFLQERIKVNGKAGNLGGGVVTIERSKSKITVTSEVPFSKRYLKYLTKKYLKKNNLRDWLRVVANSKESYELRYFQINQDEE

SEQ ID NO: 74008 - protein, 48 aa, Homo sapiens
  Payload ID: 14639
  Gene Symbol: RPL22
  Gene Name: ribosomal protein L22
  ENSP ID: ENSP00000467247
MDAANFEQFLQERIKVNGKAGNLGGGVVTIERSKSKITVTSEVPFSKR

SEQ ID NO: 74009 - protein, 95 aa, Homo sapiens
  Payload ID: 14639
  Gene Symbol: RPL22
  Gene Name: ribosomal protein L22
  ENSP ID: ENSP00000468274
MDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 74010 - protein, 122 aa, Homo sapiens
  Payload ID: 14640
  Gene Symbol: RPL22L1
  Gene Name: ribosomal protein L22-like 1
  Uniprot ID: Q6P5R6
  ENSP ID: ENSP00000346080
MAPQKDRKPKRSTWRFNLDLTHPVEDGIFDSGNFEQFLREKVKVNGKTGNLGNVVHIERFKNKITVVSEKQFSKRYLKYLTKKYLKKNNLRDWLRVVASDKETYELRYFQISQDEDESESED

SEQ ID NO: 74011 - protein, 64 aa, Homo sapiens
  Payload ID: 14640
  Gene Symbol: RPL22L1
  Gene Name: ribosomal protein L22-like 1
  ENSP ID: ENSP00000418909
MAPQKDRKPKRSTWRFNLDLTHPVEDGIFDSGNFGTFPSEYLGFSSLVLHFFCFKIGAISTGEG

SEQ ID NO: 74012 - protein, 121 aa, Homo sapiens
  Payload ID: 14640
  Gene Symbol: RPL22L1
  Gene Name: ribosomal protein L22-like 1
  ENSP ID: ENSP00000419041
MAPKDRKPKRSTWRFNLDLTHPVEDGIFDSGNFEQFLREKVKVNGKTGNLGNVVHIERFKNKITVVSEKQFSKRYLKYLTKKYLKKNNLRDWLRVVASDKETYELRYFQISQDEDESESED

SEQ ID NO: 74013 - protein, 142 aa, Homo sapiens
  Payload ID: 14640
  Gene Symbol: RPL22L1
  Gene Name: ribosomal protein L22-like 1
  ENSP ID: ENSP00000419713
GQKHNQDARILNCFSRLPGSCHEQKDRKPKRSTWRFNLDLTHPVEDGIFDSGNFEQFLREKVKVNGKTGNLGNVVHIERFKNKITVVSEKQFSKRYLKYLTKKYLKKNNLRDWLRVVASDKETYELRYFQISQDEDESESED

SEQ ID NO: 74014 - protein, 63 aa, Homo sapiens
  Payload ID: 14640
  Gene Symbol: RPL22L1
  Gene Name: ribosomal protein L22-like 1
  ENSP ID: ENSP00000420039
MAPKDRKPKRSTWRFNLDLTHPVEDGIFDSGNFGTFPSEYLGFSSLVLHFFCFKIGAISTGEG

SEQ ID NO: 74015 - protein, 91 aa, Homo sapiens
  Payload ID: 14641
  Gene Symbol: RPL23
  Gene Name: ribosomal protein L23
  ENSP ID: ENSP00000367336
MAGSRRECRRGGSSGAKFRISLGLPVGAVINCADNTGAKNLYIISVKGIKGRLNRLPAAGVGDMVMATVKKGKPELRKKVHPAVVIRQRKS

SEQ ID NO: 74016 - protein, 140 aa, Homo sapiens [sequence omitted]

SEQ ID NO: 74017 - protein, 114 aa, Homo sapiens
  Payload ID: 14641
  Gene Symbol: RPL23
  Gene Name: ribosomal protein L23
  ENSP ID: ENSP00000377866
MSKRGRGGSSGAKFRISLGLPVGAVINCADNTGAKNLYIISVKGIKGRLNRLPAAGVGDMVMATVKKGKPELRKKVLLCHTGWSAVTPLKLTVTLNCWTWNPPAVAFKGLQLQV

SEQ ID NO: 74018 - protein, 140 aa, Homo sapiens [sequence omitted]

SEQ ID NO: 74019 - protein, 122 aa, Homo sapiens
  Payload ID: 14641
  Gene Symbol: RPL23
  Gene Name: ribosomal protein L23
  ENSP ID: ENSP00000462773
MSKRGRGGSSGAKFRISLGLPVGAVINCADNTGAKNLYIISVKGIKGRLNRLPAAGVGDMVMATVKKGKPELRKKVHPAVVIRQRKSYRRKDGVFLYFEDNAGVIVNNKGEMKGRKSVQLVP

SEQ ID NO: 74020 - protein, 81 aa, Homo sapiens
  Payload ID: 14641
  Gene Symbol: RPL23
  Gene Name: ribosomal protein L23
  ENSP ID: ENSP00000463014
MVMATVKKGKPELRKKVHPAVVIRQRKSYRRKDGVFLYFEDNAGVIVNNKGEMKGSAITGPVAKECADLWPRIASNAGSIA

SEQ ID NO: 74021 - protein, 34 aa, Homo sapiens
  Payload ID: 14641
  Gene Symbol: RPL23
  Gene Name: ribosomal protein L23
  ENSP ID: ENSP00000463894
MVMATVKKGKPELRKKVHPAVVIRQRKSYRRKDG

SEQ ID NO: 74022 - protein, 158 aa, Homo sapiens
  Payload ID: 14642
  Gene Symbol: RPL23A
  Gene Name: ribosomal protein L23a
  ENSP ID: ENSP00000347969
  MOD_RES (1)..(1): Any amino acid
XLVGAPCPRASPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 74023 - protein, 194 aa, Homo sapiens
  Payload ID: 14642
  Gene Symbol: RPL23A
  Gene Name: ribosomal protein L23a
  ENSP ID: ENSP00000378396
MHPLVGAPCPRACKELVPSALTIFLLVHVQPGYITRPSLRSVVLRWAPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 74024 - protein, 156 aa, Homo sapiens [sequence omitted]

SEQ ID NO: 74025 - protein, 170 aa, Homo sapiens
  Payload ID: 14642
  Gene Symbol: RPL23A
  Gene Name: ribosomal protein L23a
  ENSP ID: ENSP00000465342
  MOD_RES (1)..(1): Any amino acid
XAPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKVSFLPTNPLMLTPWVQMMHMLATKA

SEQ ID NO: 74026 - protein, 70 aa, Homo sapiens
  Payload ID: 14642
  Gene Symbol: RPL23A
  Gene Name: ribosomal protein L23a
  ENSP ID: ENSP00000466425
MKKIEDNNTLVFIVDVKANKHQIKQAVKKLYDIDVAKVNTLIRPDGEKKAYVRLAPDYDALDVANKIGII

SEQ ID NO: 74027 - protein, 70 aa, Homo sapiens; identical to SEQ ID NO: 74026
  Payload ID: 14642
  Gene Symbol: RPL23A
  Gene Name: ribosomal protein L23a
  ENSP ID: ENSP00000468172

SEQ ID NO: 74028 - protein, 175 aa, Homo sapiens
  Payload ID: 14642
  Gene Symbol: RPL23A
  Gene Name: ribosomal protein L23a
  ENSP ID: ENSP00000468402
GQTFGSGKLHASTGWSSMSPGLVVLRWAPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 74029 - protein, 157 aa, Homo sapiens [sequence omitted]

SEQ ID NO: 74030 - protein, 121 aa, Homo sapiens
  Payload ID: 14643
  Gene Symbol: RPL24
  Gene Name: ribosomal protein L24
  ENSP ID: ENSP00000419179
MKVELCSFSGYKIYPGHGRRYARTDGKVFQFLNAKCESAFLSKRNPRQINWTVLYRRKHKKGQSEEIQKKRTRRAVKFQRAITGASLADIMAKRNQKPEVRKAQREQAIRHLQRQHLSKRL

SEQ ID NO: 74031 - protein, 150 aa, Homo sapiens
  Payload ID: 14643
  Gene Symbol: RPL24
  Gene Name: ribosomal protein L24
  ENSP ID: ENSP00000420380
MKVELCSFSGYKIYPGHGRRYARTDGKVFQFLNAKCESAFLSKRNPRQINWTVLYRRKHKKGQSEEIQKKRTRRAVKFQRAITGASLADIMAKRNQKPEVRKAQREQAIRAAKEAKKAKQASKKTAMAAAKVIMGFLYFLEQYNRKIFFF

SEQ ID NO: 74032 - protein, 145 aa, Homo sapiens [sequence omitted]

SEQ ID NO: 74033 - protein, 63 aa, Homo sapiens
  Payload ID: 14644
  Gene Symbol: RPL26
  Gene Name: ribosomal protein L26
  ENSP ID: ENSP00000462249
VVRGHYKGQQIGKVVQVYRKKYVIYIERVQREKANGTTVHVGIHPSKLGSVFFLFFCRWLSLG

SEQ ID NO: 74034 - protein, 145 aa, Homo sapiens [sequence omitted]

SEQ ID NO: 74035 - protein, 63 aa, Homo sapiens
  Payload ID: 14644
  Gene Symbol: RPL26
  Gene Name: ribosomal protein L26
  ENSP ID: ENSP00000462619
MKFNPFVTSDRSKNRKRHFNAPSHIRRKIMSSPLSKELRQKYNVRSMPIRKDDEVQEVSMFGH

SEQ ID NO: 74036 - protein, 96 aa, Homo sapiens
  Payload ID: 14644
  Gene Symbol: RPL26
  Gene Name: ribosomal protein L26
  ENSP ID: ENSP00000463021
MKFNPFVTSDRSKNRKRHFNAPSHIRRKIMSSPLSKELRQKYNVRSMPIRKDDEVQVVRGHYKGQQIGKVVQVYRKKYVIYIERVQREKANGTTVH

SEQ ID NO: 74037 - protein, 145 aa, Homo sapiens [sequence omitted]

SEQ ID NO: 74038 - protein, 145 aa, Homo sapiens [sequence omitted]

SEQ ID NO: 74039 - protein, 110 aa, Homo sapiens
  Payload ID: 14644
  Gene Symbol: RPL26
  Gene Name: ribosomal protein L26
  ENSP ID: ENSP00000463910
MKFNPFVTSDRSKNRKRHFNAPSHIRRKIMSSPLSKELRQKYNVRSMPIRKDDEVQVVRGHYKGQQIGKVVQVYRKKYVIYIERVQREKANGTTVHVGIHPSKVGVFENA

SEQ ID NO: 74040 - protein, 135 aa, Homo sapiens
  Payload ID: 14644
  Gene Symbol: RPL26
  Gene Name: ribosomal protein L26
  ENSP ID: ENSP00000464143
  MOD_RES (1)..(1): Any amino acid
XKFNPFVTSDRSKNRKRHFNAPSHIRRKIMSSPLSKELRQKYNVRSMPIRKDDEVQVVRGHYKGQQIGKVVQVYRKKYVIYIERVQREKANGTTVHVGIHPSKAKTGQRPQKDPRTESQISPSRKGKGQIQGRNH

SEQ ID NO: 74041 - protein, 107 aa, Homo sapiens
  Payload ID: 14644
  Gene Symbol: RPL26
  Gene Name: ribosomal protein L26
  ENSP ID: ENSP00000464239
MKFNPFVTSDRSKNRKRHFNAPSHIRRKIMSSPLSKELRQKYNVRSMPIRKDDEVQVVRGHYKGQQIGKVVQVYRKKYVIYIERVQREKANGTTVHVGIHPSKVVIT

SEQ ID NO: 74042 - protein, 145 aa, Homo sapiens
  Payload ID: 14645
  Gene Symbol: RPL26L1
  Gene Name: ribosomal protein L26-like 1
  Uniprot ID: Q9UNX3
  ENSP ID: ENSP00000265100
MKFNPFVTSDRSKNRKRHFNAPSHVRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQVGKEKGKYKEELIEKMQE

SEQ ID NO: 74043 - protein, 145 aa, Homo sapiens; identical to SEQ ID NO: 74042
  Payload ID: 14645
  Gene Symbol: RPL26L1
  Gene Name: ribosomal protein L26-like 1
  Uniprot ID: Q9UNX3
  ENSP ID: ENSP00000428177

SEQ ID NO: 74044 - protein, 145 aa, Homo sapiens; identical to SEQ ID NO: 74042
  Payload ID: 14645
  Gene Symbol: RPL26L1
  Gene Name: ribosomal protein L26-like 1
  Uniprot ID: Q9UNX3
  ENSP ID: ENSP00000428223

SEQ ID NO: 74045 - protein, 38 aa, Homo sapiens
  Payload ID: 14645
  Gene Symbol: RPL26L1
  Gene Name: ribosomal protein L26-like 1
  ENSP ID: ENSP00000429783
MKFNPFVTSDRSKNRKRHFNAPSHVRRKIMSSPLSKEL

SEQ ID NO: 74046 - protein, 145 aa, Homo sapiens; identical to SEQ ID NO: 74042
  Payload ID: 14645
  Gene Symbol: RPL26L1
  Gene Name: ribosomal protein L26-like 1
  Uniprot ID: Q9UNX3
  ENSP ID: ENSP00000430147

SEQ ID NO: 74047 - protein, 128 aa, Homo sapiens
  Payload ID: 14645
  Gene Symbol: RPL26L1
  Gene Name: ribosomal protein L26-like 1
  ENSP ID: ENSP00000430673
MKFNPFVTSDRSKNRKRHFNAPSHVRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQV

SEQ ID NO: 74048 - protein, 136 aa, Homo sapiens [sequence omitted]

SEQ ID NO: 74049 - protein, 136 aa, Homo sapiens [sequence omitted]

SEQ ID NO: 74050 - protein, 144 aa, Homo sapiens
  Payload ID: 14646
  Gene Symbol: RPL27
  Gene Name: ribosomal protein L27
  ENSP ID: ENSP00000466019
  MOD_RES (1)..(1): Any amino acid
XRKAVIVKVSASRDSASLHAGTRLAAAGRAGLEFKNIDDGTSDRPYSHALVAGIDRYPRKVTAAMGKKKIAKRSKIKSFVKVYNYNHLMPTRYSVDIPLDKTVVNKDVFRDPALKRKARREAKVKFEERYKTGKNKWFFQKLRF

SEQ ID NO: 74051 - protein, 136 aa, Homo sapiens [sequence omitted]

SEQ ID NO: 74052 - protein, 80 aa, Homo sapiens
  Payload ID: 14646
  Gene Symbol: RPL27
  Gene Name: ribosomal protein L27
  ENSP ID: ENSP00000467939
MGKKKIAKRSKIKSFVKVYNYNHLMPTRYSVDIPLDKTVVNKDVFRDPALKRKARREAKVKFEERYKTGKNKWFFQKLRF

SEQ ID NO: 74053 - protein, 40 aa, Homo sapiens
  Payload ID: 14646
  Gene Symbol: RPL27
  Gene Name: ribosomal protein L27
  ENSP ID: ENSP00000468468
MGKFMKPGKVVLVLAGRYSGRKAVIVKVLCGYPLGQNCRQ

SEQ ID NO: 74054 - protein, 148 aa, Homo sapiens [sequence omitted]

SEQ ID NO: 74055 - protein, 91 aa, Homo sapiens
  Payload ID: 14647
  Gene Symbol: RPL27A
  Gene Name: ribosomal protein L27a
  ENSP ID: ENSP00000431565
MKHYHLKRNQSFCPTVNLDKLWTLVSEQTRVNAAKNKTGAAPIIDVVRSGYYKVLGKGKLPKQPVIVKAKFFSRRAEEKIKSVGGACVLVA

SEQ ID NO: 74056 - protein, 91 aa, Homo sapiens; identical to SEQ ID NO: 74055
  Payload ID: 14647
  Gene Symbol: RPL27A
  Gene Name: ribosomal protein L27a
  ENSP ID: ENSP00000431849

SEQ ID NO: 74057 - protein, 91 aa, Homo sapiens; identical to SEQ ID NO: 74055
  Payload ID: 14647
  Gene Symbol: RPL27A
  Gene Name: ribosomal protein L27a
  ENSP ID: ENSP00000432671

SEQ ID NO: 74058 - protein, 108 aa, Homo sapiens
  Payload ID: 14647
  Gene Symbol: RPL27A
  Gene Name: ribosomal protein L27a
  ENSP ID: ENSP00000433259
MPSRLRKTRKLRGHVSHGHGRIGKHRKHPGGRGNAGGLHHHRINFDKYHPGYFGKVGMKHYHLKRNQSFCPTVNLDKLWTLVSEQTRVNAAKNKTGAAPIIDVVRSVS

SEQ ID NO: 74059 - protein, 91 aa, Homo sapiens; identical to SEQ ID NO: 74055
  Payload ID: 14647
  Gene Symbol: RPL27A
  Gene Name: ribosomal protein L27a
  ENSP ID: ENSP00000433766

SEQ ID NO: 74060 - protein, 113 aa, Homo sapiens
  Payload ID: 14647
  Gene Symbol: RPL27A
  Gene Name: ribosomal protein L27a
  ENSP ID: ENSP00000435081
MPSRLRKTRKLRGHVSHGHGRIGKHRKHPGGRGNAGGLHHHRINFDKYEQTRVNAAKNKTGAAPIIDVVRSGYYKVLGKGKLPKQPVIVKAKFFSRRAEEKIKSVGGACVLVA

SEQ ID NO: 74061 - protein, 41 aa, Homo sapiens
  Payload ID: 14647
  Gene Symbol: RPL27A
  Gene Name: ribosomal protein L27a
  ENSP ID: ENSP00000435333
MPSRLRKTRKLRGHVSHGHGRIVESGVSPCWPGWSRTPDLR

SEQ ID NO: 74062 - protein, 42 aa, Homo sapiens
  Payload ID: 14647
  Gene Symbol: RPL27A
  Gene Name: ribosomal protein L27a
  ENSP ID: ENSP00000437118
  MOD_RES (1)..(1): Any amino acid
XKTRKLRGHVSHGHGRIGKHRKHPGGRGNAGGLHHHRINFDK

SEQ ID NO: 74063 - protein, 137 aa, Homo sapiens [sequence omitted]

SEQ ID NO: 74064 - protein, 69 aa, Homo sapiens
  Payload ID: 14648
  Gene Symbol: RPL28
  Gene Name: ribosomal protein L28
  Uniprot ID: P46779
  ENSP ID: ENSP00000391665
MSAHLQWMVVRNCSSFLIKRNKQTYSTEPNNLKARNSFRYNGLIHRKTVGVEPAADGKGVVVVIKRRSE

SEQ ID NO: 74065 - protein, 87 aa, Homo sapiens
  Payload ID: 14648
  Gene Symbol: RPL28
  Gene Name: ribosomal protein L28
  Uniprot ID: P46779
  ENSP ID: ENSP00000400596
MSAHLQWMVVRNCSSFLIKRNKQTYSTEPNNLKARNSFRYNGLIHRKTVGVEPAADGKGVVVVIKRRSGEFCLVWARERPLSRVWEL

SEQ ID NO: 74066 - protein, 170 aa, Homo sapiens
  Payload ID: 14648
  Gene Symbol: RPL28
  Gene Name: ribosomal protein L28
  ENSP ID: ENSP00000452763
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMLAGRVGRQQAVSSLEHQPRPGRLHLSNTAARSFCVMEPSRTLQDLGSTLGLHPLDASGTPEL

SEQ ID NO: 74067 - protein, 169 aa, Homo sapiens
  Payload ID: 14648
  Gene Symbol: RPL28
  Gene Name: ribosomal protein L28
  Uniprot ID: P46779
  ENSP ID: ENSP00000452909
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMDMLASTGSGLCCSVAVQPWASSSTSLCLRTLICNMRVDRPYYSGLMRRLNVQNLLDCAHKS

SEQ ID NO: 74068 - protein, 163 aa, Homo sapiens
  Payload ID: 14648
  Gene Symbol: RPL28
  Gene Name: ribosomal protein L28
  Uniprot ID: P46779
  ENSP ID: ENSP00000453029
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMVSWGLGIRLGETGQCCGEGPPTTGCNMGWRGMDSCFQPTPHTQHWPRGRLVECMG

SEQ ID NO: 74069 - protein, 89 aa, Homo sapiens
  Payload ID: 14648
  Gene Symbol: RPL28
  Gene Name: ribosomal protein L28
  ENSP ID: ENSP00000453285
MSAHLQWMVVRNCSSFLIKRNKQTYSTEPNNLKARNSFRYNGLIHRKTVGVEPAADGKGVVVASGSLPPPMCGPPSTRMLAPRSAASDT

SEQ ID NO: 74070 - protein, 137 aa, Homo sapiens [sequence omitted]

SEQ ID NO: 74071 - protein, 112 aa, Homo sapiens
  Payload ID: 14648
  Gene Symbol: RPL28
  Gene Name: ribosomal protein L28
  ENSP ID: ENSP00000453584
MSAHLQWMVVRNCSSFLIKRNKQTYSTEPNNLKARNSFRYNGLIHRKTVGVEPAADGKGVVVVIKRRSGRKSGNCHRGGHPWRQGVGLGTGFPLGRLVSSVSRARLSPCPHL

SEQ ID NO: 74072 - protein, 159 aa, Homo sapiens [sequence omitted]

SEQ ID NO: 74073 - protein, 159 aa, Homo sapiens [sequence omitted]

SEQ ID NO: 74074 - protein, 159 aa, Homo sapiens [sequence omitted]

SEQ ID NO: 74075 - protein, 159 aa, Homo sapiens [sequence omitted]

SEQ ID NO: 74076 - protein, 60 aa, Homo sapiens
  Payload ID: 14649
  Gene Symbol: RPL29
  Gene Name: ribosomal protein L29
  ENSP ID: ENSP00000418839
MAKSKNHTTHNQSRKWHRNGIKKPRSQRYESLKGVSALNHMEVSFLGSRCTVKASHVVFL

SEQ ID NO: 74077 - protein, 159 aa, Homo sapiens [sequence omitted]

SEQ ID NO: 74078 - protein, 37 aa, Homo sapiens
  Payload ID: 14649
  Gene Symbol: RPL29
  Gene Name: ribosomal protein L29
  ENSP ID: ENSP00000419333
MAKSKNHTTHNQSRKWHRNGIKKPRSQRYESLKGPEV

SEQ ID NO: 74079 - protein, 159 aa, Homo sapiens [sequence omitted]

SEQ ID NO: 74080 - protein, 403 aa, Homo sapiens
  Payload ID: 14650
  Gene Symbol: RPL3
  Gene Name: ribosomal protein L3
  Uniprot ID: P39023
  ENSP ID: ENSP00000346001
MSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 74081 - protein, 272 aa, Homo sapiens
  Payload ID: 14650
  Gene Symbol: RPL3
  Gene Name: ribosomal protein L3
  ENSP ID: ENSP00000385762
MTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYG

SEQ ID NO: 74082 - protein, 351 aa, Homo sapiens
  Payload ID: 14650
  Gene Symbol: RPL3
  Gene Name: ribosomal protein L3
  ENSP ID: ENSP00000386101
MTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRTEINKKIYKIGQGYLIKDGKLIKNNASTDYDLSDKSINPLGGFVHYGEVTNDFVMLKGCVVGTKKRVLTLRKSLLVQTKRRALEKIDLKFIDTTSKFGHGRFQTMEEKKAFMGPLKKDRIAKEEGA

SEQ ID NO: 74083 - protein, 261 aa, Homo sapiens
  Payload ID: 14650
  Gene Symbol: RPL3
  Gene Name: ribosomal protein L3
  ENSP ID: ENSP00000412713
  MOD_RES (1)..(1): Any amino acid
XVCVVMAAVSLSPASARLNPRRIAAIPSWPAPGSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYK

SEQ ID NO: 74084 - protein, 305 aa, Homo sapiens
  Payload ID: 14650
  Gene Symbol: RPL3
  Gene Name: ribosomal protein L3
  ENSP ID: ENSP00000415198
QMMNLLTGGQKLCADCHVLIWLCGVLWPSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQQVPVNQVFGQDEMIDVIGVTKGKGYKGVTSRWHTKKLPRKTHRGLRKVACIGAWHPARVAFSVARAGQKGYHHRT

SEQ ID NO: 74085 - protein, 180 aa, Homo sapiens
  Payload ID: 14650
  Gene Symbol: RPL3
  Gene Name: ribosomal protein L3
  ENSP ID: ENSP00000416273
MSHRKFSAPRHGSLGFLPRKRSSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNCSARLCPMSSIQAPLAGGKGSLEAGNELHPHAVPVCLPLTPRRGDEGLHLVPSPTLLCS

SEQ ID NO: 74086 - protein, 115 aa, Homo sapiens [sequence omitted]

SEQ ID NO: 74087 - protein, 96 aa, Homo sapiens
  Payload ID: 14651
  Gene Symbol: RPL30
  Gene Name: ribosomal protein L30
  ENSP ID: ENSP00000379381
MVAAKKTKKSLESINSRLQLVMKSGKYVLGYKQTLKMIRQGKAKLVILANNCPALSGNNIELGTACGKYYRVCTLAIIDPGDSDIIRSMPEQTGEK

SEQ ID NO: 74088 - protein, 115 aa, Homo sapiens [sequence omitted]

SEQ ID NO: 74089 - protein, 114 aa, Homo sapiens
  Payload ID: 14651
  Gene Symbol: RPL30
  Gene Name: ribosomal protein L30
  ENSP ID: ENSP00000429483
MVAAKKTKKSLESINSRLQLVMKSGKYVLGYKQTLKMIRQGKAKLVILANNCPALRKSEIEYYAMLAKTGVHHYSGNNIELGTACGKYYRVCTLAIIDPGDSDIIRSMPEQTGE

SEQ ID NO: 74090 - protein, 51 aa, Homo sapiens
  Payload ID: 14651
  Gene Symbol: RPL30
  Gene Name: ribosomal protein L30
  ENSP ID: ENSP00000430506
MLAKTGVHHYSGNNIELGTACGKYYRVCTLAIIDPGDSDIIRSMPEQTGEK

SEQ ID NO: 74091 - protein, 56 aa, Homo sapiens
  Payload ID: 14651
  Gene Symbol: RPL30
  Gene Name: ribosomal protein L30
  ENSP ID: ENSP00000430556
MVAAKKTKKSLESINSRLQLVMKSGKYVLGYKQTLKMIRQGKAKLVILANNCPALR

SEQ ID NO: 74092 - protein, 125 aa, Homo sapiens [sequence omitted]

SEQ ID NO: 74093 - protein, 120 aa, Homo sapiens
  Payload ID: 14652
  Gene Symbol: RPL31
  Gene Name: ribosomal protein L31
  ENSP ID: ENSP00000386271
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKNCHHQ

SEQ ID NO: 74094 - protein, 125 aa, Homo sapiens [sequence omitted]

SEQ ID NO: 74095 - protein, 128 aa, Homo sapiens
  Payload ID: 14652
  Gene Symbol: RPL31
  Gene Name: ribosomal protein L31
  Uniprot ID: P62899
  ENSP ID: ENSP00000386717
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKISVLNSVTVAKSP

SEQ ID NO: 74096 - protein, 130 aa, Homo sapiens
  Payload ID: 14652
  Gene Symbol: RPL31
  Gene Name: ribosomal protein L31
  ENSP ID: ENSP00000386737
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKSLQNDDLFKTDCHHQ

SEQ ID NO: 74097 - protein, 79 aa, Homo sapiens
  Payload ID: 14652
  Gene Symbol: RPL31
  Gene Name: ribosomal protein L31
  ENSP ID: ENSP00000387112
MAPAKKGGEKKKGRSAINEVVTREYTINIHKRIHGVGFKKRAPRALKEIRKFAMKEMGTPDVRIDTRLNKAVWAKGIRC

SEQ ID NO: 74098 - protein, 79 aa, Homo sapiens; identical to SEQ ID NO: 74097
  Payload ID: 14652
  Gene Symbol: RPL31
  Gene Name: ribosomal protein L31
  ENSP ID: ENSP00000387120

SEQ ID NO: 74099 - protein, 121 aa, Homo sapiens
  Payload ID: 14652
  Gene Symbol: RPL31
  Gene Name: ribosomal protein L31
  Uniprot ID: P62899
  ENSP ID: ENSP00000387163
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKSKFSIP

SEQ ID NO: 74100 - protein, 79 aa, Homo sapiens; identical to SEQ ID NO: 74097
  Payload ID: 14652
  Gene Symbol: RPL31
  Gene Name: ribosomal protein L31
  ENSP ID: ENSP00000402450

SEQ ID NO: 74101 - protein, 108 aa, Homo sapiens
  Payload ID: 14652
  Gene Symbol: RPL31
  Gene Name: ribosomal protein L31
  ENSP ID: ENSP00000408172
  MOD_RES (1)..(1): Any amino acid
XRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKIFFLR

SEQ ID NO: 74102 - protein, 115 aa, Homo sapiens
  Payload ID: 14652
  Gene Symbol: RPL31
  Gene Name: ribosomal protein L31
  ENSP ID: ENSP00000412976
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFK

SEQ ID NO: 74103 - protein, 153 aa, Homo sapiens
  Payload ID: 14653
  Gene Symbol: RPL32
  Gene Name: ribosomal protein L32
  ENSP ID: ENSP00000339064
MAALRPLVKPKIVKKRTKKFIRHQSDRYVKIKEEFALCTDANPPVYYFLQRNWRKPRGIDNRVRRRFKGQILMPNIGYGSNKKTKHMLPSGFRKFLVHNVKELEVLLMCNKSYCAEIAHNVSSKNRKAIVERAAQLAIRVTNPNARLRSEENE

SEQ ID NO: 74104 - protein, 135 aa, Homo sapiens [sequence omitted]

SEQ ID NO: 74105 - protein, 135 aa, Homo sapiens [sequence omitted]

SEQ ID NO: 74106 - protein, 135 aa, Homo sapiens [sequence omitted]

SEQ ID NO: 74107 - protein, 133 aa, Homo sapiens
  Payload ID: 14653
  Gene Symbol: RPL32
  Gene Name: ribosomal protein L32
  ENSP ID: ENSP00000412393
MAALRPLVKPKIVKKRTKKFIRHQSDRYVKIKRNWRKPRGIDNRVRRRFKGQILMPNIGYGSNKKTKHMLPSGFRKFLVHNVKELEVLLMCNKSYCAEIAHNVSSKNRKAIVERAAQLAIRVTNPNARLRSEE

SEQ ID NO: 74108 - protein, 62 aa, Homo sapiens
  Payload ID: 14653
  Gene Symbol: RPL32
  Gene Name: ribosomal protein L32
  ENSP ID: ENSP00000413742
MAALRPLVKPKIVKKRTKKFIRHQSDRYVKIKRNWRKPRGIDNRVRRRFKGQILMPNIGYGS

SEQ ID NO: 74109 - protein, 135 aa, Homo sapiens [sequence omitted]

SEQ ID NO: 74110 - protein, 117 aa, Homo sapiens [sequence omitted]

SEQ ID NO: 74111 - protein, 117 aa, Homo sapiens [sequence omitted]

SEQ ID NO: 74112 - protein, 117 aa, Homo sapiens [sequence omitted]

SEQ ID NO: 74113 - protein, 117 aa, Homo sapiens [sequence omitted]

SEQ ID NO: 74114 - protein, 117 aa, Homo sapiens [sequence omitted]

SEQ ID NO: 74115 - protein, 123 aa, Homo sapiens [sequence omitted]

SEQ ID NO: 74116 - protein, 96 aa, Homo sapiens
  Payload ID: 14655
  Gene Symbol: RPL35
  Gene Name: ribosomal protein L35
  ENSP ID: ENSP00000362671
MAKIKARDLRGKKKEELLKQLDDLKVELSQLRVAKVTGGAASKLSKIRVVRKSIARVLTVINQTQKENLRKFYKAAAGGPCIQMDRVLPQPPACSC

SEQ ID NO: 74117 - protein, 96 aa, Homo sapiens; identical to SEQ ID NO: 74116
  Payload ID: 14655
  Gene Symbol: RPL35
  Gene Name: ribosomal protein L35
  ENSP ID: ENSP00000437215

SEQ ID NO: 74118 - protein, 96 aa, Homo sapiens; identical to SEQ ID NO: 74116
  Payload ID: 14655
  Gene Symbol: RPL35
  Gene Name: ribosomal protein L35
  ENSP ID: ENSP00000486088

SEQ ID NO: 74119 - protein, 94 aa, Homo sapiens
  Payload ID: 14656
  Gene Symbol: RPL35A
  Gene Name: ribosomal protein L35a
  ENSP ID: ENSP00000387688
MSGRLWSKAIFAGYKRGLRNQREHTALLKIEGVYARDETEFYLGKRCAYVYKAKNNTVTPGGKPNKTRVIWGKVTRAHGNSGMVRAKFRSNLPA

SEQ ID NO: 74120 - protein, 110 aa, Homo sapiens [sequence omitted]

SEQ ID NO: 74121 - protein, 55 aa, Homo sapiens
  Payload ID: 14656
  Gene Symbol: RPL35A
  Gene Name: ribosomal protein L35a
  ENSP ID: ENSP00000398058
MSGRLWSKAIFAGYKRGLRNQREHTALLKIEGVYARDETEFYLGKRCAYVYKAKK

SEQ ID NO: 74122 - protein, 57 aa, Homo sapiens
  Payload ID: 14656
  Gene Symbol: RPL35A
  Gene Name: ribosomal protein L35a
  ENSP ID: ENSP00000410683
MSGRLWSKAIFAGYKRGLRNQREHTALLKIEGVYARDETEFYLGKRCAYVYKAKNWD

SEQ ID NO: 74123 - protein, 110 aa, Homo sapiens [sequence omitted]

SEQ ID NO: 74124 - protein, 105 aa, Homo sapiens [sequence omitted]

SEQ ID NO: 74125 - protein, 105 aa, Homo sapiens [sequence omitted]

SEQ ID NO: 74126 - protein, 105 aa, Homo sapiens [sequence omitted]

SEQ ID NO: 74127 - protein, 68 aa, Homo sapiens
  Payload ID: 14657
  Gene Symbol: RPL36
  Gene Name: ribosomal protein L36
  ENSP ID: ENSP00000462927
MALRYPMAVGLNKGHKVTKNVSKPRHSRRRGREHLESGAGQRVWGSDAGVGVRSWSWPEVAVCEVEGF

SEQ ID NO: 74128 - protein, 105 aa, Homo sapiens [sequence omitted]

SEQ ID NO: 74129 - protein, 94 aa, Homo sapiens
  Payload ID: 14657
  Gene Symbol: RPL36
  Gene Name: ribosomal protein L36
  ENSP ID: ENSP00000464613
MALRYPMAVGLNKGHKVTKNVSKPRHSRRRGRLTKHTKFVRDMIREVCGFAPYERRAMELLKVSKDKRALKFIKKRVGGRCRPRGGVGWESGPG

SEQ ID NO: 74130 - protein, 70 aa, Homo sapiens
  Payload ID: 14658
  Gene Symbol: RPL36A
  Gene Name: ribosomal protein L36a
  ENSP ID: ENSP00000361940
MVNVPKTRRTFCKKCGKHQPHKVTQYKKGKDSLYAQGKRRYDRKQSGYGGQTKPIFRKKRQKIEECALLS

SEQ ID NO: 74131 - protein, 112 aa, Homo sapiens
  Payload ID: 14658
  Gene Symbol: RPL36A
  Gene Name: ribosomal protein L36a
  ENSP ID: ENSP00000397659
MVNVPKTRRTFCKKCGKHQPHKVTQYKKGKDSLYAQGKRRYDRKQSGYGGQTKPIFRKKAKTTKKIVLRLECVEPNCRSKRMLAIKRCKHFELGGDKKRKVYNYGWKVQSFS

SEQ ID NO: 74132 - protein, 142 aa, Homo sapiens
  Payload ID: 14658
  Gene Symbol: RPL36A
  Gene Name: ribosomal protein L36a
  ENSP ID: ENSP00000404375
MIAPTDSHEEVRSGTSYILPFASRFLSFRADSAHASMVNVPKTRRTFCKKCGKHQPHKVTQYKKGKDSLYAQGKRRYDRKQSGYGGQTKPIFRKKAKTTKKIVLRLECVEPNCRSKRMLAIKRCKHFELGGDKKRKGQVIQF

SEQ ID NO: 74133 - protein, 106 aa, Homo sapiens [sequence omitted]

SEQ ID NO: 74134 - protein, 25 aa, Homo sapiens
  Payload ID: 14658
  Gene Symbol: RPL36A
  Gene Name: ribosomal protein L36a
  ENSP ID: ENSP00000473451
MLAIKRCKHFELGGDKKRKGQVIQF

SEQ ID NO: 74135 - protein, 142 aa, Homo sapiens; identical to SEQ ID NO: 74132
  Payload ID: 14658
  Gene Symbol: RPL36A
  Gene Name: ribosomal protein L36a
  ENSP ID: ENSP00000483017

SEQ ID NO: 74136 - protein, 106 aa, Homo sapiens
  Payload ID: 14659
  Gene Symbol: RPL36AL
  Gene Name: ribosomal protein L36a-like
  Uniprot ID: Q969Q0
  ENSP ID: ENSP00000346012
MVNVPKTRRTFCKKCGKHQPHKVTQYKKGKDSLYAQGRRRYDRKQSGYGGQTKPIFRKKAKTTKKIVLRLECVEPNCRSKRMLAIKRCKHFELGGDKKRKGQVIQF

SEQ ID NO: 74137 - protein, 97 aa, Homo sapiens [sequence omitted]

SEQ ID NO: 74138 - protein, 74 aa, Homo sapiens
  Payload ID: 14660
  Gene Symbol: RPL37
  Gene Name: ribosomal protein L37
  ENSP ID: ENSP00000422823
MTKGTSSFGKRRNKTHTLCRRCGSKAYHLQKSTCGKCGYPAKRKRKCMDSVKEQHLNPRGQLLQHPVHLKNVND

SEQ ID NO: 74139 - protein, 82 aa, Homo sapiens
  Payload ID: 14660
  Gene Symbol: RPL37
  Gene Name: ribosomal protein L37
  ENSP ID: ENSP00000426449
MTKGTSSFGKRRNKTHTLCRRCGSKAYHLQKSTCGKCGYPAKRKRKYNWSAKAKRRNTTGTGRMRHLKIVYRRFRYSLYVRS

SEQ ID NO: 74140 - protein, 75 aa, Homo sapiens
  Payload ID: 14661
  Gene Symbol: RPL37A
  Gene Name: ribosomal protein L37a
  ENSP ID: ENSP00000388690
MAKRTKKVGIVGKYGTRYGASLRKMVKKIEISQHAKYTCSFCGKTKMKRRAVGIWHCGSCMKTVAGGAWTYNRME

SEQ ID NO: 74141 - protein, 58 aa, Homo sapiens
  Payload ID: 14661
  Gene Symbol: RPL37A
  Gene Name: ribosomal protein L37a
  ENSP ID: ENSP00000410080
MAKRTKKVGIVGKYGTRYGASLRKMVKKIEISQHAKYTCSFCGKGEREAFTSLTIRPR

SEQ ID NO: 74142 - protein, 68 aa, Homo sapiens
  Payload ID: 14661
  Gene Symbol: RPL37A
  Gene Name: ribosomal protein L37a
  ENSP ID: ENSP00000410240
MVKKIEISQHAKYTCSFCGKTKMKRRAVGIWHCGSCMKTVAGGAWTYNTTSAVTVKSAIRRLKELKDQ

SEQ ID NO: 74143 - protein, 92 aa, Homo sapiens [sequence omitted]

SEQ ID NO: 74144 - protein, 60 aa, Homo sapiens
  Payload ID: 14661
  Gene Symbol: RPL37A
  Gene Name: ribosomal protein L37a
  ENSP ID: ENSP00000469607
MVKKIEISQHAKYTCSFCGKTKMKRRAVGIWHCGSCMKTVAGGAWTYKDAKMEPNLHELC

SEQ ID NO: 74145 - protein, 72 aa, Homo sapiens
  Payload ID: 14661
  Gene Symbol: RPL37A
  Gene Name: ribosomal protein L37a
  ENSP ID: ENSP00000470348
MAKRTKKVGIVGKYGTRYGASLRKMVKKIEISQHAKYTCSFCGKTKMKRRAVGIWHCGSCMKTVAGGAWTYK

SEQ ID NO: 74146 - protein, 60 aa, Homo sapiens; identical to SEQ ID NO: 74144
  Payload ID: 14661
  Gene Symbol: RPL37A
  Gene Name: ribosomal protein L37a
  ENSP ID: ENSP00000471102

SEQ ID NO: 74147 - protein, 88 aa, Homo sapiens
  Payload ID: 14661
  Gene Symbol: RPL37A
  Gene Name: ribosomal protein L37a
  ENSP ID: ENSP00000472653
MVKKIEISQHAKYTCSFCGKTKMKRRAVGIWHCGSCMKTVAGGAWTYKKMSAENGQQREPLMSFDHQEMPKWNQISMNSANGRRGKGR

SEQ ID NO: 74148 - protein, 70 aa, Homo sapiens [sequence omitted]

SEQ ID NO: 74149 - protein, 70 aa, Homo sapiens [sequence omitted]

SEQ ID NO: 74150 - protein, 70 aa, Homo sapiens [sequence omitted]

SEQ ID NO: 74151 - protein, 21 aa, Homo sapiens
  Payload ID: 14662
  Gene Symbol: RPL38
  Gene Name: ribosomal protein L38
  ENSP ID: ENSP00000462580
MPRKIEEIKDFLLTARRKDAK

SEQ ID NO: 74152 - protein, 64 aa, Homo sapiens
  Payload ID: 14662
  Gene Symbol: RPL38
  Gene Name: ribosomal protein L38
  ENSP ID: ENSP00000462837
MPRKIEEIKDFLLTARRKDAKSVKIKKNKDNVKFKVRCSRYLYTLVITDKEKAEKLKQSLPPGE

SEQ ID NO: 74153 - protein, 67 aa, Homo sapiens
  Payload ID: 14662
  Gene Symbol: RPL38
  Gene Name: ribosomal protein L38
  ENSP ID: ENSP00000463312
MPRKIEEIKDFLLTARRKDAKSVKIKKNKDNVKFKVRCSRYLYTLVITDKEKAEKLKQSLPPVKELK

SEQ ID NO: 74154 - protein, 51 aa, Homo sapiens [sequence omitted]

SEQ ID NO: 74155 - protein, 51 aa, Homo sapiens
  Payload ID: 14664
  Gene Symbol: RPL39L
  Gene Name: ribosomal protein L39-like
  Uniprot ID: Q96EH5
  ENSP ID: ENSP00000296277
MSSHKTFTIKRFLAKKQKQNRPIPQWIQMKPGSKIRYNSKRRHWRRTKLGL

SEQ ID NO: 74156 - protein, 51 aa, Homo sapiens; identical to SEQ ID NO: 74155
  Payload ID: 14664
  Gene Symbol: RPL39L
  Gene Name: ribosomal protein L39-like
  Uniprot ID: Q96EH5
  ENSP ID: ENSP00000389356

SEQ ID NO: 74157 - protein, 51 aa, Homo sapiens; identical to SEQ ID NO: 74155
  Payload ID: 14664
  Gene Symbol: RPL39L
  Gene Name: ribosomal protein L39-like
  Uniprot ID: Q96EH5
  ENSP ID: ENSP00000397240

SEQ ID NO: 74158 - protein, 407 aa, Homo sapiens
  Payload ID: 14665
  Gene Symbol: RPL3L
  Gene Name: ribosomal protein L3-like
  Uniprot ID: Q92901
  ENSP ID: ENSP00000268661
MSHRKFSAPRHGHLGFLPHKRSHRHRGKVKTWPRDDPSQPVHLTAFLGYKAGMTHTLREVHRPGLKISKREEVEAVTIVETPPLVVVGVVGYVATPRGLRSFKTIFAEHLSDECRRRFYKDWHKSKKKAFTKACKRWRDTDGKKQLQKDFAAMKKYCKVIRVIVHTQMKLLPFRQKKAHIMEIQLNGGTVAEKVAWAQARLEKQVPVHSVFSQSEVIDVIAVTKGRGVKGVTSRWHTKKLPRKTHKGLRKVACIGAWHPARVGCSIARAGQKGYHHRTELNKKIFRIGRGPHMEDGKLVKNNASTSYDVTAKSITPLGGFPHYGEVNNDFVMLKGCIAGTKKRVITLRKSLLVHHSRQAVENIELKFIDTTSKFGHGRFQTAQEKRAFMGPQKKHLEKETPETSGDL

SEQ ID NO: 74159 - protein, 43 aa, Homo sapiens
  Payload ID: 14665
  Gene Symbol: RPL3L
  Gene Name: ribosomal protein L3-like
  ENSP ID: ENSP00000455856
MTHTLREVHRPGLKISKREEVEAVTIVETPPLVVVGVVGYVAT

SEQ ID NO: 74160 - protein, 427 aa, Homo sapiens [sequence omitted]

SEQ ID NO: 74161 - protein, 333 aa, Homo sapiens
  Payload ID: 14666
  Gene Symbol: RPL4
  Gene Name: ribosomal protein L4
  ENSP ID: ENSP00000454281
MCRGGRMFAPTKTWRRWHRRVNTTQKRYAICSALAASALPALVMSKGHRIEEVPELPLVVEDKVEGYKKTKEAVLLLKKLKAWNDIKKVYASQRMRAGKGKMRNRRRIQRRGPCIIYNEDNGIIKAFRNIPGITLLNVSKLNILKLAPGGHVGRFCIWTESAFRKLDELYGTWRKAASLKSNYNLPMHKMINTDLSRILKSPEIQRALRAPRKKIHRRVLKKNPLKNLRIMLKLNPYAKTMRRNTILRQARNHKLRVDKAAAAAAALQAKSDEKAAVAGKKPVVGKKGKKAAVGVKKQKKPLVGKKAAATKKPAPEKKPAEKKPTTEEKKPAA

SEQ ID NO: 74162 - protein, 170 aa, Homo sapiens
  Payload ID: 14666
  Gene Symbol: RPL4
  Gene Name: ribosomal protein L4
  ENSP ID: ENSP00000457268
MACARPLISVYSEKGESSGKNVTLPAVFKAPIRPDIVNFVHTNLRKNNRQPYAVSELAGHQTSAESWGTGRAVARIPRVRGGGTHRSGQGAFGNMCRGGRMFAPTKTWRRWHRRVNTTQKRYAICSALAASALPALVMSKVEDKVEGYKKTKEAVLLLKKLKAWNDIKKV

SEQ ID NO: 74163 - protein, 171 aa, Homo sapiens
  Payload ID: 14666
  Gene Symbol: RPL4
  Gene Name: ribosomal protein L4
  ENSP ID: ENSP00000457442
MACARPLISVYSEKGESSGKNVTLPAVFKAPIRPDIVNFVHTNLRKNNRQPYAVSELAGHQTSAESWGTGRAVARIPRVRGGGTHRSGQGAFGNMCRGGRMFAPTKTWRRWHRRKNPLKNLRIMLKLNPYAKTMRRNTILRQARNHKLRVDKAAAAAAALQAKSDEKAAVA

SEQ ID NO: 74164 - protein, 25 aa, Homo sapiens [sequence omitted]

SEQ ID NO: 74165 - protein, 25 aa, Homo sapiens [sequence omitted]

SEQ ID NO: 74166 - protein, 130 aa, Homo sapiens
  Payload ID: 14668
  Gene Symbol: RPL5
  Gene Name: ribosomal protein L5
  ENSP ID: ENSP00000359338
MIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRF

SEQ ID NO: 74167 - protein, 297 aa, Homo sapiens [sequence omitted]

SEQ ID NO: 74168 - protein, 63 aa, Homo sapiens
  Payload ID: 14668
  Gene Symbol: RPL5
  Gene Name: ribosomal protein L5
  ENSP ID: ENSP00000473675
MGFVKVVKNKAYFKRYQVKFRRRREGKTDYYARKRLVIQDKNKYNTPKYRMIVRVTNRDIICQ

SEQ ID NO: 74169 - protein, 288 aa, Homo sapiens [sequence omitted]

SEQ ID NO: 74170 - protein, 288 aa, Homo sapiens [sequence omitted]

SEQ ID NO: 74171 - protein, 105 aa, Homo sapiens
  Payload ID: 14669
  Gene Symbol: RPL6
  Gene Name: ribosomal protein L6
  ENSP ID: ENSP00000446859
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTR

SEQ ID NO: 74172 - protein, 159 aa, Homo sapiens
  Payload ID: 14669
  Gene Symbol: RPL6
  Gene Name: ribosomal protein L6
  ENSP ID: ENSP00000446883
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPTEDVPRKLLSHGKKPFSQHVRKLRASITPGTILIILTGRHRG

SEQ ID NO: 74173 - protein, 120 aa, Homo sapiens
  Payload ID: 14669
  Gene Symbol: RPL6
  Gene Name: ribosomal protein L6
  ENSP ID: ENSP00000448067
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPTED

SEQ ID NO: 74174 - protein, 63 aa, Homo sapiens
  Payload ID: 14669
  Gene Symbol: RPL6
  Gene Name: ribosomal protein L6
  ENSP ID: ENSP00000448570
MPRYYPTEDVPRKLLSHGKKPFSQHVRKLRASITPGTILIILTGRHRGKRVVFLKQLASGLLL

SEQ ID NO: 74175 - protein, 118 aa, Homo sapiens
  Payload ID: 14669
  Gene Symbol: RPL6
  Gene Name: ribosomal protein L6
  ENSP ID: ENSP00000449486
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPT

SEQ ID NO: 74176 - protein, 160 aa, Homo sapiens
  Payload ID: 14669
  Gene Symbol: RPL6
  Gene Name: ribosomal protein L6
  ENSP ID: ENSP00000476161
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPTEDVPRKLLSHGKKPFSQHVRKLRASITPGTILIILTGRHRGK

SEQ ID NO: 74177 - protein, 248 aa, Homo sapiens
  Payload ID: 14670
  Gene Symbol: RPL7
  Gene Name: ribosomal protein L7
  Uniprot ID: P18124
  ENSP ID: ENSP00000339795
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHFVEGGDAGNREDQINRLIRRMN

SEQ ID NO: 74178 - protein, 208 aa, Homo sapiens
  Payload ID: 14670
  Gene Symbol: RPL7
  Gene Name: ribosomal protein L7
  ENSP ID: ENSP00000379729
MLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHFVEGGDAGNREDQINRLIRRMN

SEQ ID NO: 74179 - protein, 208 aa, Homo sapiens; identical to SEQ ID NO: 74178
  Payload ID: 14670
  Gene Symbol: RPL7
  Gene Name: ribosomal protein L7
  ENSP ID: ENSP00000379730

SEQ ID NO: 74180 - protein, 208 aa, Homo sapiens; identical to SEQ ID NO: 74178
  Payload ID: 14670
  Gene Symbol: RPL7
  Gene Name: ribosomal protein L7
  ENSP ID: ENSP00000379731

SEQ ID NO: 74181 - protein, 88 aa, Homo sapiens
  Payload ID: 14670
  Gene Symbol: RPL7
  Gene Name: ribosomal protein L7
  ENSP ID: ENSP00000401300
MLRKARRKLIYEKAKHYHKEYRQMYRTEIRMARMARKAGNFYVPAEPKLAFVIRIRGINGVSPKVRKVLQLLRLRQIFNGTFVKLNKA

SEQ ID NO: 74182 - protein, 99 aa, Homo sapiens
  Payload ID: 14670
  Gene Symbol: RPL7
  Gene Name: ribosomal protein L7
  ENSP ID: ENSP00000415808
MLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPY

SEQ ID NO: 74183 - protein, 151 aa, Homo sapiens; identical to SEQ ID NO: 514
  Payload ID: 14671
  Gene Symbol: RPL7A
  Gene Name: ribosomal protein L7a
  ENSP ID: ENSP00000361071

SEQ ID NO: 74184 - protein, 266 aa, Homo sapiens [sequence omitted]

SEQ ID NO: 74185 - protein, 191 aa, Homo sapiens; identical to SEQ ID NO: 513
  Payload ID: 14671
  Gene Symbol: RPL7A
  Gene Name: ribosomal protein L7a
  ENSP ID: ENSP00000416638

SEQ ID NO: 74186 - protein, 246 aa, Homo sapiens
  Payload ID: 14672
  Gene Symbol: RPL7L1
  Gene Name: ribosomal protein L7-like 1
  Uniprot ID: Q6DKI1
  ENSP ID: ENSP00000346063
MAEQEQRKIPLVPENLLKKRKAYQALKATQAKQALLAKKEQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWGFPNLKSVRELILKRGQAKVKNKTIPLTDNTVIEEHLGKFGVICLEDLIHEIAFPGKHFQEISWFLCPFHLSVARHATKNRVGFLKEMGTPGYRGERINQLIRQLN

SEQ ID NO: 74187 - protein, 246 aa, Homo sapiens; identical to SEQ ID NO: 74186
  Payload ID: 14672
  Gene Symbol: RPL7L1
  Gene Name: ribosomal protein L7-like 1
  Uniprot ID: Q6DKI1
  ENSP ID: ENSP00000418221

SEQ ID NO: 74188 - protein, 196 aa, Homo sapiens
  Payload ID: 14672
  Gene Symbol: RPL7L1
  Gene Name: ribosomal protein L7-like 1
  ENSP ID: ENSP00000473356
MAEQEQRKIPLVPENLLKKRKAYQALKATQAKQALLAKKEQKKGKGLRFKRLESFLHDSWRQKRDKVRLRRLEVKPHALELPDKHSLAFVVRIERIDGVSLLVQRTIARLRLKKIFSGVFVKVTPQNLKMLRIVEPYVTWGFPNLKSVRELILKRGQAKVKNKTIPLTDNTVIEEHLGECYSLGISWGRKPGSLKL

SEQ ID NO: 74189 - protein, 257 aa, Homo sapiens [sequence omitted]

SEQ ID NO: 74190 - protein, 257 aa, Homo sapiens [sequence omitted]

SEQ ID NO: 74191 - protein, 257 aa, Homo sapiens [sequence omitted]

SEQ ID NO: 74192 - protein, 167 aa, Homo sapiens
  Payload ID: 14673
  Gene Symbol: RPL8
  Gene Name: ribosomal protein L8
  ENSP ID: ENSP00000433703
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVG

SEQ ID NO: 74193 - protein, 205 aa, Homo sapiens
  Payload ID: 14673
  Gene Symbol: RPL8
  Gene Name: ribosomal protein L8
  ENSP ID: ENSP00000434535
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRAVVGVVAGGGRIDKPILKAGRAYHKYKAKRNCWPRVRGVAMN

SEQ ID NO: 74194 - protein, 235 aa, Homo sapiens
  Payload ID: 14673
  Gene Symbol: RPL8
  Gene Name: ribosomal protein L8
  ENSP ID: ENSP00000435313
MGRVIRGQRKGAGSVFRAHVKHRKGAARLRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKE

SEQ ID NO: 74195 - protein, 148 aa, Homo sapiens
  Payload ID: 14673
  Gene Symbol: RPL8
  Gene Name: ribosomal protein L8
  ENSP ID: ENSP00000436460
MGRVIRGQRKGAGSVFRAHVKHRKGAARLRAVDFAERHGYIKGIVKKVISSANRAVVGVVAGGGRIDKPILKAGRAYHKYKAKRNCWPRVRGVAMNPVEHPFGGGNHQHIGKPSTIRRDAPAGRKVGLIAARRTGRLRGTKTVQEKEN

SEQ ID NO: 74196 - protein, 110 aa, Homo sapiens
  Payload ID: 14673
  Gene Symbol: RPL8
  Gene Name: ribosomal protein L8
  ENSP ID: ENSP00000437062
  MOD_RES (1)..(1): Any amino acid
XALRACAPWISLSGTATSRASSRWSSGIRIGLRSGRSCSLPPRAFTRASLCIAARRPSSTLAMCSLWAPCLRVQSCAAWRRSLETVASWPGHQGTMPPLSPTTLRPRRPV

SEQ ID NO: 74197 - protein, 192 aa, Homo sapiens [sequence omitted]

SEQ ID NO: 74198 - protein, 192 aa, Homo sapiens [sequence omitted]

SEQ ID NO: 74199 - protein, 181 aa, Homo sapiens
  Payload ID: 14674
  Gene Symbol: RPL9
  Gene Name: ribosomal protein L9
  ENSP ID: ENSP00000421872
MKTILSNQTVDIPENVDITLKGRTVIVKGPRGTLRRDFNHINVELSLLGKKKKRLRVDKWWGNRKELATVRTICSHVQNMIKGVTLGFRYKMRSVYAHFPINVVIQENGSLVEIRNFLGEKYIRRVRMRPVSQAQKDELILEGNDIELVSNSAALIQQATTVKNKDIRKFLDGIYVSEKGT

SEQ ID NO: 74200 - protein, 166 aa, Homo sapiens
  Payload ID: 14674
  Gene Symbol: RPL9
  Gene Name: ribosomal protein L9
  ENSP ID: ENSP00000422191
MKTILSNQTVDIPENVDITLKGRTVIVKGPRGTLRRDFNHINVELSLLGKKKKRLRVDKWWGNRKELATVRTICSHVQNMIKGVTLGFRYKMRSVYAHFPINVVIQENGSLVEIRNFLGEKYIRRVRMRPGVACSVSQAQKDELILEGNDIELVSNSAALIQQATT

SEQ ID NO: 74201 - protein, 91 aa, Homo sapiens
  Payload ID: 14674
  Gene Symbol: RPL9
  Gene Name: ribosomal protein L9
  ENSP ID: ENSP00000424796
  MOD_RES (1)..(1): Any amino acid
XLRVDKWWGNRKELATVRTICSHVQNMIKGVACSVSQAQKDELILEGNDIELVSNSAALIQQATTVKNKDIRKFLDGIYVSEKGTVQQADE

SEQ ID NO: 74202 - protein, 189 aa, Homo sapiens
  Payload ID: 14674
  Gene Symbol: RPL9
  Gene Name: ribosomal protein L9
  ENSP ID: ENSP00000425250
  MOD_RES (1)..(1): Any amino acid
XTDVLSLLRLLRVDITLKGRTVIVKGPRGTLRRDFNHINVELSLLGKKKKRLRVDKWWGNRKELATVRTICSHVQNMIKGVTLGFRYKMRSVYAHFPINVVIQENGSLVEIRNFLGEKYIRRVRMRPGVACSVSQAQKDELILEGNDIELVSNSAALIQQATTVKNKDIRKFLDGIYVSEKGTVQQADE

SEQ ID NO: 74203 - protein, 165 aa, Homo sapiens
  Payload ID: 14675
  Gene Symbol: RPS10
  Gene Name: ribosomal protein S10
  Uniprot ID: P46783
  ENSP ID: ENSP00000347271
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 74204 - protein, 172 aa, Homo sapiens
  Payload ID: 14675
  Gene Symbol: RPS10
  Gene Name: ribosomal protein S10
  ENSP ID: ENSP00000363169
MLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFVLIAHDCSQIMSFVKRKHVQ

SEQ ID NO: 74205 - protein, 165 aa, Homo sapiens; identical to SEQ ID NO: 74203
  Payload ID: 14675
  Gene Symbol: RPS10
  Gene Name: ribosomal protein S10
  Uniprot ID: P46783
  ENSP ID: ENSP00000481646

SEQ ID NO: 74206 - protein, 158 aa, Homo sapiens [sequence omitted]

SEQ ID NO: 74207 - protein, 82 aa, Homo sapiens
  Payload ID: 14676
  Gene Symbol: RPS11
  Gene Name: ribosomal protein S11
  ENSP ID: ENSP00000470375
IQVRTRGWMPGLSVPTKSSRPSFKTRRGSCWEKLARRSSRGTTRTSVWASRHPRRLLRAPTLTRNAPSLVMCPFEGGSSLAW

SEQ ID NO: 74208 - protein, 118 aa, Homo sapiens
  Payload ID: 14676
  Gene Symbol: RPS11
  Gene Name: ribosomal protein S11
  ENSP ID: ENSP00000470447
MADIQTERAYQKQPTIFQNKKRVLLGETGKEKLPRYYKNIGLGFKTPKEAIEGTYIDKKCPFTGNVSIRGRILSGVVTKMKMQRTIVIRRDYLHYIRKYNRFEKRHKNMSVHLSPCFR

SEQ ID NO: 74209 - protein, 79 aa, Homo sapiens
  Payload ID: 14676
  Gene Symbol: RPS11
  Gene Name: ribosomal protein S11
  ENSP ID: ENSP00000471873
MKMQRTIVIRRDYLHYIRKYNRFEKRHKNMSVHLSPCFRDVQIGDIVTVGECRPLSKTVRFNVLKVTKAAGTKKQFQKF

SEQ ID NO: 74210 - protein, 88 aa, Homo sapiens
  Payload ID: 14676
  Gene Symbol: RPS11
  Gene Name: ribosomal protein S11
  ENSP ID: ENSP00000471874
MADIQTERAYQKQPTIFQNKKRVLLGETGKEKLPRADPLWRGDQDEDAEDHCHPPRLSALHPQVQPLREAPQEHVCTPVPLLQGRPDR

SEQ ID NO: 74211 - protein, 132 aa, Homo sapiens [sequence omitted]

SEQ ID NO: 74212 - protein, 148 aa, Homo sapiens
  Payload ID: 14678
  Gene Symbol: RPS13
  Gene Name: ribosomal protein S13
  ENSP ID: ENSP00000228140
MGRMHAPGKGLSQSALPYRRSVPTWLKLTSDDVKEQIYKLAKKGLTPSQIGVILRDSHGVAQVRFVTGNKILRILKSKGLAPDLPEDLYHLIKKAVAVRKHLERNRKRAGFTVWLDIIRPSESSLPIGNMNHLQPLPWSHKFVCVLKQ

SEQ ID NO: 74213 - protein, 116 aa, Homo sapiens
  Payload ID: 14678
  Gene Symbol: RPS13
  Gene Name: ribosomal protein S13
  ENSP ID: ENSP00000432096
MGRMHAPGKGLSQSALPYRRSVPTWLKLTSDDVKEQIYKLAKKGLTPSQIVLLLSPSLECSGAISAHCNLHLLDSSDSPASASRIGVILRDSHGVAQVRFVTGNKILRILKSKGLA

SEQ ID NO: 74214 - protein, 151 aa, Homo sapiens [sequence omitted]

SEQ ID NO: 74215 - protein, 151 aa, Homo sapiens [sequence omitted]

SEQ ID NO: 74216 - protein, 151 aa, Homo sapiens [sequence omitted]

SEQ ID NO: 74217 - protein, 151 aa, Homo sapiens [sequence omitted]

SEQ ID NO: 74218 - protein, 151 aa, Homo sapiens [sequence omitted]

SEQ ID NO: 74219 - protein, 120 aa, Homo sapiens
  Payload ID: 14679
  Gene Symbol: RPS14
  Gene Name: ribosomal protein S14
  ENSP ID: ENSP00000428536
  MOD_RES (1)..(1): Any amino acid
XMKVKADRDESSPYAAMLAAQDVAQRCKELGITALHIKLRATGGNRTKTPGPGAQSALRALARSGMKIGRIGKCPPLANAWVYFEALAPKSTCCAQWMCSGWSGHFWQLSLLREAARGTL

SEQ ID NO: 74220 - protein, 134 aa, Homo sapiens
  Payload ID: 14679
  Gene Symbol: RPS14
  Gene Name: ribosomal protein S14
  ENSP ID: ENSP00000429856
MAPRKGKEKKEEQVISLGPQVAEGENVFGVCHIFASFNDTFVHVTDLSGKETICRVTGGMKVKADRDESSPYAAMLAAQDVAQRCKELGITALHIKLRATGGNRTKTPGPGAQSALRALARSGMKIGRIEKTVG

SEQ ID NO: 74221 - protein, 129 aa, Homo sapiens
  Payload ID: 14680
  Gene Symbol: RPS15
  Gene Name: ribosomal protein S15
  ENSP ID: ENSP00000465055
MAEVEQKKKRTFRKFTYRGVDLDQLLDMSYEQLMQLYSARQRRRLNRGLRRKQHSLLKRLRKAKKEAPPMEKPEVVKTHLRDMIILPEMVGSMVGVYNGKTFNQVEIKVCAAVPAGWGGLGSPDAGGIS

SEQ ID NO: 74222 - protein, 152 aa, Homo sapiens [sequence omitted]

SEQ ID NO: 74223 - protein, 112 aa, Homo sapiens
  Payload ID: 14680
  Gene Symbol: RPS15
  Gene Name: ribosomal protein S15
  ENSP ID: ENSP00000466366
MQLYSARQRRRLNRGLRRKQHSLLKRLRKAKKEAPPMEKPEVVKTHLRDMIILPEMVGSMVGVYNGKTFNQVEIKPEMIGHYLGEFSITYKPVKHGRPGIGATHSSRFIPLK

SEQ ID NO: 74224 - protein, 145 aa, Homo sapiens [sequence omitted]

SEQ ID NO: 74225 - protein, 112 aa, Homo sapiens; identical to SEQ ID NO: 74223
  Payload ID: 14680
  Gene Symbol: RPS15
  Gene Name: ribosomal protein S15
  ENSP ID: ENSP00000467676

SEQ ID NO: 74226 - protein, 141 aa, Homo sapiens
  Payload ID: 14680
  Gene Symbol: RPS15
  Gene Name: ribosomal protein S15
  ENSP ID: ENSP00000467855
MAEVEQKKKRTFRKFTYRGVDLDQLLDMSYEQLMQLYSARQRRRLNRGLRRKQHSLLKRLRKAKKEAPPMEKPEVVKTHLRDMIILPEMVGSMVGVYNGKTFNQPEMIGHYLGEFSITYKPVKHGRPGIGATHSSRFIPLK

SEQ ID NO: 74227 - protein, 118 aa, Homo sapiens
  Payload ID: 14680
  Gene Symbol: RPS15
  Gene Name: ribosomal protein S15
  ENSP ID: ENSP00000473953
MSYEQLMQLYSARQRRRLNRGLRRKQHSLLKRLRKAKKEAPPMEKPEVVKTHLRDMIILPEMVGSMVGVYNGKTFNQVEIKPEMIGHYLGEFSITYKPVKHGRPGIGATHSSRFIPLK

SEQ ID NO: 74228 - protein, 118 aa, Homo sapiens; identical to SEQ ID NO: 74227
  Payload ID: 14680
  Gene Symbol: RPS15
  Gene Name: ribosomal protein S15
  ENSP ID: ENSP00000474433

SEQ ID NO: 74229 - protein, 112 aa, Homo sapiens; identical to SEQ ID NO: 74223
  Payload ID: 14680
  Gene Symbol: RPS15
  Gene Name: ribosomal protein S15
  ENSP ID: ENSP00000474543

SEQ ID NO: 74230 - protein, 135 aa, Homo sapiens
  Payload ID: 14680
  Gene Symbol: RPS15
  Gene Name: ribosomal protein S15
  ENSP ID: ENSP00000474970
MRRVSPGRAAHKTAWCILPSEQLMQLYSARQRRRLNRGLRRKQHSLLKRLRKAKKEAPPMEKPEVVKTHLRDMIILPEMVGSMVGVYNGKTFNQVEIKPEMIGHYLGEFSITYKPVKHGRPGIGATHSSRFIPLK

SEQ ID NO: 74231 - protein, 68 aa, Homo sapiens
  Payload ID: 14680
  Gene Symbol: RPS15
  Gene Name: ribosomal protein S15
  ENSP ID: ENSP00000475096
MQLYSARQRRRLNRGLRRKQHSLLKRLRKAKKEAPPMEKPEVVKTHLRDMIILPEMVGSMVGVYNGKT

SEQ ID NO: 74232 - protein, 7 aa, Homo sapiens
  Payload ID: 14680
  Gene Symbol: RPS15
  Gene Name: ribosomal protein S15
  ENSP ID: ENSP00000483399
MQLYSAR

SEQ ID NO: 74233 - protein, 130 aa, Homo sapiens [sequence omitted]

SEQ ID NO: 74234 - protein, 130 aa, Homo sapiens [sequence omitted]

SEQ ID NO: 74235 - protein, 50 aa, Homo sapiens
  Payload ID: 14681
  Gene Symbol: RPS15A
  Gene Name: ribosomal protein S15a
  ENSP ID: ENSP00000457001
MVRMNVLADALKSINNAEKRGKRQVLIRPCSKVIVRFLTVMMKHELGKLL

SEQ ID NO: 74236 - protein, 49 aa, Homo sapiens
  Payload ID: 14681
  Gene Symbol: RPS15A
  Gene Name: ribosomal protein S15a
  ENSP ID: ENSP00000457924
MVRMNVLADALKSINNAEKRGKRQVLIRPCSKVIVRFLTVMMKHVSYLL

SEQ ID NO: 74237 - protein, 58 aa, Homo sapiens
  Payload ID: 14681
  Gene Symbol: RPS15A
  Gene Name: ribosomal protein S15a
  ENSP ID: ENSP00000458052
  MOD_RES (1)..(1): Any amino acid
XCGVISPRFDVQLKDLEKWQNNLLPSRQFGIYTLQIMRLVPWLKVFSLHGCCITVSLY

SEQ ID NO: 74238 - protein, 130 aa, Homo sapiens [sequence omitted]

SEQ ID NO: 74239 - protein, 130 aa, Homo sapiens [sequence omitted]

SEQ ID NO: 74240 - protein, 111 aa, Homo sapiens
  Payload ID: 14681
  Gene Symbol: RPS15A
  Gene Name: ribosomal protein S15a
  ENSP ID: ENSP00000459373
MVRMNVLADALKSINNAEKRGKRQVLIRPCSKVIVRFLTVMMKHGYIGEFEIIDDHRAGKIVVNLTGRLNKVGVQWHDLGYCNLCLPGSSDSPASASLVAEITVWGDQPQI

SEQ ID NO: 74241 - protein, 111 aa, Homo sapiens; identical to SEQ ID NO: 74240
  Payload ID: 14681
  Gene Symbol: RPS15A
  Gene Name: ribosomal protein S15a
  ENSP ID: ENSP00000459554

SEQ ID NO: 74242 - protein, 52 aa, Homo sapiens
  Payload ID: 14681
  Gene Symbol: RPS15A
  Gene Name: ribosomal protein S15a
  ENSP ID: ENSP00000460069
MVRMNVLADALKSINNAEKRGKRQVLIRPCSKVIVRFLTVMMKHVWGDQPQI

SEQ ID NO: 74243 - protein, 100 aa, Homo sapiens
  Payload ID: 14681
  Gene Symbol: RPS15A
  Gene Name: ribosomal protein S15a
  ENSP ID: ENSP00000460618
MVRMNVLADALKSINNAEKRGKRQVLIRPCSKVIVRFLTVMMKHGYIGEFEIIDDHRAGKIVVNLTGRLNKCGVISPRFDVQLKDLEKWQNNLLPSRQFG

SEQ ID NO: 74244 - protein, 146 aa, Homo sapiens [sequence omitted]

SEQ ID NO: 74245 - protein, 152 aa, Homo sapiens
  Payload ID: 14682
  Gene Symbol: RPS16
  Gene Name: ribosomal protein S16
  ENSP ID: ENSP00000367806
MPSKGPLQSVQVFGRKKTATAVAHCKRGNGLIKVNGRPLEMIEPRTLQYKLLEPVLLLGKERFAGVDIRVRVKGGGHVAQIYGESQELGAWRRWLWEGGLHSAPVPFNCVSFSQLSVSPSPKPWWPITRNMWMRLPRRRSKTSSSSMTGPCW

SEQ ID NO: 74246 - protein, 50 aa, Homo sapiens
  Payload ID: 14682
  Gene Symbol: RPS16
  Gene Name: ribosomal protein S16
  ENSP ID: ENSP00000468957
LLEPVLLLGKERFAGVDIRVRVKGGGHVAQIYAIRQSISKALVAYYQKCE

SEQ ID NO: 74247 - protein, 85 aa, Homo sapiens
  Payload ID: 14682
  Gene Symbol: RPS16
  Gene Name: ribosomal protein S16
  ENSP ID: ENSP00000471983
TATAVAHCKRGNGLIKVNGRPLEMIEPRTLQYKLLEPVLLLGKERFAGVDIRVRVKGGGHVAQIYAIRQSISKALVAYYQKCECG

SEQ ID NO: 74248 - protein, 129 aa, Homo sapiens
  Payload ID: 14682
  Gene Symbol: RPS16
  Gene Name: ribosomal protein S16
  ENSP ID: ENSP00000472231
MPSKGPLQSVQVFGRKKTATAVAHCKRGNGLIKLLEPVLLLGKERFAGVDIRVRVKGGGHVAQIYAIRQSISKALVAYYQKYVDEASKKEIKDILIQYDRTLLVADPRRCESKKFGGPGARARYQKSYR

SEQ ID NO: 74249 - protein, 100 aa, Homo sapiens
  Payload ID: 14682
  Gene Symbol: RPS16
  Gene Name: ribosomal protein S16
  ENSP ID: ENSP00000473220
MPSKGPLQSVQVFGRKKTATAVAHCKRGNGLIKVNGRPLEMIEPRTLQYKLLEPVLLLGKERFAGVDIRVRVKGGGHVAQIYAIRQSISKALVAYYQKCE

SEQ ID NO: 74250 - protein, 135 aa, Homo sapiens [sequence omitted]

SEQ ID NO: 74251 - protein, 191 aa, Homo sapiens
  Payload ID: 14683
  Gene Symbol: RPS17
  Gene Name: ribosomal protein S17
  ENSP ID: ENSP00000452889
MGRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLLAYVAPFVSALAESACFSSVKAFLWCLHANHSEMSFGPFPGLRQSVQPSGHSAYSWDEFQNASGTCLNFFCSAVLFSINLGQ

SEQ ID NO: 74252 - protein, 59 aa, Homo sapiens
  Payload ID: 14683
  Gene Symbol: RPS17
  Gene Name: ribosomal protein S17
  ENSP ID: ENSP00000453894
  MOD_RES (1)..(1): Any amino acid
XRVRTKTVKKAARVIIEKYYTRLGNDFHTNKRVCEEIAIIPSKKLRNKIAGCSYCSRDL

SEQ ID NO: 74253 - protein, 136 aa, Homo sapiens
  Payload ID: 14683
  Gene Symbol: RPS17
  Gene Name: ribosomal protein S17
  ENSP ID: ENSP00000453910
MGRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLVSVCWIPKVVFSWSKTISRSYYPRSPS

SEQ ID NO: 74254 - protein, 135 aa, Homo sapiens [sequence omitted]

SEQ ID NO: 74255 - protein, 59 aa, Homo sapiens; identical to SEQ ID NO: 74252
  Payload ID: 14683
  Gene Symbol: RPS17
  Gene Name: ribosomal protein S17
  ENSP ID: ENSP00000487741
  MOD_RES (1)..(1): Any amino acid

SEQ ID NO: 74256 - protein, 136 aa, Homo sapiens; identical to SEQ ID NO: 74253
  Payload ID: 14683
  Gene Symbol: RPS17
  Gene Name: ribosomal protein S17
  ENSP ID: ENSP00000488464

SEQ ID NO: 74257 - protein, 152 aa, Homo sapiens [sequence omitted]

SEQ ID NO: 74258 - protein, 34 aa, Homo sapiens
  Payload ID: 14684
  Gene Symbol: RPS18
  Gene Name: ribosomal protein S18
  ENSP ID: ENSP00000392349
MSLVIPEKFQHILRVLNTNIDGRRKIAFAITAIK

SEQ ID NO: 74259 - protein, 152 aa, Homo sapiens [sequence omitted]

SEQ ID NO: 74260 - protein, 152 aa, Homo sapiens [sequence omitted]

SEQ ID NO: 74261 - protein, 152 aa, Homo sapiens [sequence omitted]

SEQ ID NO: 74262 - protein, 152 aa, Homo sapiens [sequence omitted]

SEQ ID NO: 74263 - protein, 82 aa, Homo sapiens
  Payload ID: 14684
  Gene Symbol: RPS18
  Gene Name: ribosomal protein S18
  ENSP ID: ENSP00000431721
MQNPRQYKIPDWFLNRQKDVKDGKYSQVLANGLDNKLREDLERLKKIRAHRGLRHFWGLRVRGQHTKTTGRRGRTVGVSKKK

SEQ ID NO: 74264 - protein, 82 aa, Homo sapiens; identical to SEQ ID NO: 74263
  Payload ID: 14684
  Gene Symbol: RPS18
  Gene Name: ribosomal protein S18
  ENSP ID: ENSP00000431986

SEQ ID NO: 74265 - protein, 82 aa, Homo sapiens; identical to SEQ ID NO: 74263
  Payload ID: 14684
  Gene Symbol: RPS18
  Gene Name: ribosomal protein S18
  ENSP ID: ENSP00000432580

SEQ ID NO: 74266 - protein, 82 aa, Homo sapiens; identical to SEQ ID NO: 74263
  Payload ID: 14684
  Gene Symbol: RPS18
  Gene Name: ribosomal protein S18
  ENSP ID: ENSP00000434786

SEQ ID NO: 74267 - protein, 82 aa, Homo sapiens; identical to SEQ ID NO: 74263
  Payload ID: 14684
  Gene Symbol: RPS18
  Gene Name: ribosomal protein S18
  ENSP ID: ENSP00000434837

SEQ ID NO: 74268 - protein, 82 aa, Homo sapiens; identical to SEQ ID NO: 74263
  Payload ID: 14684
  Gene Symbol: RPS18
  Gene Name: ribosomal protein S18
  ENSP ID: ENSP00000437050

SEQ ID NO: 74269 - protein, 33 aa, Homo sapiens
  Payload ID: 14684
  Gene Symbol: RPS18
  Gene Name: ribosomal protein S18
  ENSP ID: ENSP00000485840
SLVIPEKFQHILRVLNTNIDGRRKIAFAITAIK

SEQ ID NO: 74270 - protein, 71 aa, Homo sapiens
  Payload ID: 14685
  Gene Symbol: RPS19
  Gene Name: ribosomal protein S19
  ENSP ID: ENSP00000221975
MTKIYGGRQRNGVMPSHFSRGSKSVARRVLQALEGLKMVEKDQDGGRKLTPQGQRDLDRIAGQVAAANKKH

SEQ ID NO: 74271 - protein, 76 aa, Homo sapiens
  Payload ID: 14685
  Gene Symbol: RPS19
  Gene Name: ribosomal protein S19
  ENSP ID: ENSP00000469228
MPGVTVKDVNQQEFVRALAAFLKKSGKLKVPEWVDTVKLAKHKELAPYDENWFYTRAASTARHLYLRGGAGVGSMT

SEQ ID NO: 74272 - protein, 100 aa, Homo sapiens
  Payload ID: 14685
  Gene Symbol: RPS19
  Gene Name: ribosomal protein S19
  ENSP ID: ENSP00000469798
MPGVTVKDVNQQEFVRALAAFLKKSGKLKVPEWVDTVKLAKHKELAPYDENWFYTRAGEELSFHSAAPVPPGWRWGWLHDQDLWGTSEKRRHAQPLQPRL

SEQ ID NO: 74273 - protein, 145 aa, Homo sapiens [sequence omitted]

SEQ ID NO: 74274 - protein, 145 aa, Homo sapiens [sequence omitted]

SEQ ID NO: 74275 - protein, 102 aa, Homo sapiens
  Payload ID: 14685
  Gene Symbol: RPS19
  Gene Name: ribosomal protein S19
  ENSP ID: ENSP00000471621
MPGVTVKDVNQQEFVRALAAFLKKSGKLKVPEWVDTVKLAKHKELAPYDENWFYTRAGGLILSIYTEADSLGLDPSFTSGCVSSASTARHLYLRGGAGVGSM

SEQ ID NO: 74276 - protein, 71 aa, Homo sapiens
  Payload ID: 14685
  Gene Symbol: RPS19
  Gene Name: ribosomal protein S19
  ENSP ID: ENSP00000472660
PGVTVKDVNQQEFVRALAAFLKKSGKLKVPEWVDTVKLAKHKELAPYDENWFYTRAELHCHQAGVHWCRLG

SEQ ID NO: 74277 - protein, 136 aa, Homo sapiens
  Payload ID: 14686
  Gene Symbol: RPS19BP1
  Gene Name: ribosomal protein S19 binding protein 1
  Uniprot ID: Q86WX3
  ENSP ID: ENSP00000333948
MSAALLRRGLELLAASEAPRDPPGQAKPRGAPVKRPRKTKAIQAQKLRNSAKGKVPKSALDEYRKRECRDHLRVNLKFLTRTRSTVAESVSQQILRQNRGRKACDRPVAKTKKKKAEGTVFTEEDFQKFQQEYFGS

SEQ ID NO: 74278 - protein, 69 aa, Homo sapiens
  Payload ID: 14686
  Gene Symbol: RPS19BP1
  Gene Name: ribosomal protein S19 binding protein 1
  ENSP ID: ENSP00000399304
MSAALLRRGLELLAASEAPRDPPGQAKPRGAPVKRPRKTKAIQAQKLRNSAKGKVPKSALDGVSPCWPR

SEQ ID NO: 74279 - protein, 293 aa, Homo sapiens [sequence omitted]

SEQ ID NO: 74280 - protein, 218 aa, Homo sapiens
  Payload ID: 14687
  Gene Symbol: RPS2
  Gene Name: ribosomal protein S2
  ENSP ID: ENSP00000433034
MADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAG

SEQ ID NO: 74281 - protein, 209 aa, Homo sapiens
  Payload ID: 14687
  Gene Symbol: RPS2
  Gene Name: ribosomal protein S2
  ENSP ID: ENSP00000433170
MADDAGAAGGPGGPGGPGMGNRGGFRGGFGSGIRGRGRGRGRGRGRGRGARGGKAEDKEESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFGHL

SEQ ID NO: 74282 - protein, 63 aa, Homo sapiens
  Payload ID: 14687
  Gene Symbol: RPS2
  Gene Name: ribosomal protein S2
  ENSP ID: ENSP00000434846
  MOD_RES (1)..(1): Any amino acid
XWMPVTKLGRLVKDMKIKSLEEIYLFSLPIKQGTVVMARPKLDKAKGNLSGKPHLTKQEKKGK

SEQ ID NO: 74283 - protein, 195 aa, Homo sapiens
  Payload ID: 14687
  Gene Symbol: RPS2
  Gene Name: ribosomal protein S2
  ENSP ID: ENSP00000436227
VTKLGRLVKDMKIKSLEEIYLFSLPIKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 74284 - protein, 197 aa, Homo sapiens
  Payload ID: 14687
  Gene Symbol: RPS2
  Gene Name: ribosomal protein S2
  ENSP ID: ENSP00000436356
MADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKPRPPLMPFLRPTAT

SEQ ID NO: 74285 - protein, 235 aa, Homo sapiens
  Payload ID: 14687
  Gene Symbol: RPS2
  Gene Name: ribosomal protein S2
  ENSP ID: ENSP00000436865
MADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 74286 - protein, 44 aa, Homo sapiens
  Payload ID: 14687
  Gene Symbol: RPS2
  Gene Name: ribosomal protein S2
  ENSP ID: ENSP00000454837
MPVTKLGRLVKDMKIKSLEEIYLFSLPIKESEIIDFFLGASLKD

SEQ ID NO: 74287 - protein, 155 aa, Homo sapiens
  Payload ID: 14687
  Gene Symbol: RPS2
  Gene Name: ribosomal protein S2
  ENSP ID: ENSP00000460860
ESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFGRWSTHGA

SEQ ID NO: 74288 - protein, 119 aa, Homo sapiens [sequence omitted]

SEQ ID NO: 74289 - protein, 119 aa, Homo sapiens [sequence omitted]

SEQ ID NO: 74290 - protein, 64 aa, Homo sapiens
  Payload ID: 14688
  Gene Symbol: RPS20
  Gene Name: ribosomal protein S20
  ENSP ID: ENSP00000427860
MPTKTLRITTRKTPCGEGSKTWDRFQMRIHKRLIDLHSPSEIVKQITSISIEPGVEVEVTIADA

SEQ ID NO: 74291 - protein, 61 aa, Homo sapiens
  Payload ID: 14688
  Gene Symbol: RPS20
  Gene Name: ribosomal protein S20
  ENSP ID: ENSP00000428104
MAFKDTGKTPVEPEVAIHRIRITLTSRNVKSLEKVCADLIRGAKEKNLKVKGPVRMPTKVK

SEQ ID NO: 74292 - protein, 61 aa, Homo sapiens; identical to SEQ ID NO: 74291
  Payload ID: 14688
  Gene Symbol: RPS20
  Gene Name: ribosomal protein S20
  ENSP ID: ENSP00000428146

SEQ ID NO: 74293 - protein, 64 aa, Homo sapiens; identical to SEQ ID NO: 74290
  Payload ID: 14688
  Gene Symbol: RPS20
  Gene Name: ribosomal protein S20
  ENSP ID: ENSP00000429049

SEQ ID NO: 74294 - protein, 46 aa, Homo sapiens
  Payload ID: 14688
  Gene Symbol: RPS20
  Gene Name: ribosomal protein S20
  ENSP ID: ENSP00000429333
MAFKDTGKTPVEPEVAIHRIRITLTSRNVKSLEKDFENHYKKNSLW

SEQ ID NO: 74295 - protein, 142 aa, Homo sapiens
  Payload ID: 14688
  Gene Symbol: RPS20
  Gene Name: ribosomal protein S20
  Uniprot ID: P60866
  ENSP ID: ENSP00000429374
MAFKDTGKTPVEPEVAIHRIRITLTSRNVKSLEKVCADLIRGAKEKNLKVKGPVRMPTKTLRITTRKTPCGEGSKTWDRFQMRIHKRLIDLHSPSEIVKQITSISIEPGVELIESTDAEPMDTEGQQYTLRSVFESPGTCPF

SEQ ID NO: 74296 - protein, 142 aa, Homo sapiens; identical to SEQ ID NO: 74295
  Payload ID: 14688
  Gene Symbol: RPS20
  Gene Name: ribosomal protein S20
  Uniprot ID: P60866
  ENSP ID: ENSP00000478703

SEQ ID NO: 74297 - protein, 83 aa, Homo sapiens
  Payload ID: 14689
  Gene Symbol: RPS21
  Gene Name: ribosomal protein S21
  Uniprot ID: P63220
  ENSP ID: ENSP00000345957
MQNDAGEFVDLYVPRKCSASNRIIGAKDHASIQMNVAEVDKVTGRFNGQFKTYAICGAIRRMGESDDSILRLAKADGIVSKNF

SEQ ID NO: 74298 - protein, 66 aa, Homo sapiens
  Payload ID: 14689
  Gene Symbol: RPS21
  Gene Name: ribosomal protein S21
  ENSP ID: ENSP00000359593
MQNDAGEFVDLYVPRKCSASNRIIGAKDHASIQMNVAEVSWEPGRREGCDICAGKAGCPIVEEPLG

SEQ ID NO: 74299 - protein, 90 aa, Homo sapiens
  Payload ID: 14689
  Gene Symbol: RPS21
  Gene Name: ribosomal protein S21
  ENSP ID: ENSP00000359624
MQNDAGEFVDLYVPRKCSASNRIIGAKDHASIQMNVAEVDKVTGRFNGQFKTYAICGAIRRMVSVSLGFAHHFGTSWTLPCALECVMVPE

SEQ ID NO: 74300 - protein, 81 aa, Homo sapiens
  Payload ID: 14689
  Gene Symbol: RPS21
  Gene Name: ribosomal protein S21
  ENSP ID: ENSP00000388332
MQNDAGEFVDLYVPRKCSASNRIIGAKDHASIQMNVAEVDKVTGRFNGQFKTYAICGAIRRMGESDDSILRLAKADGIVSK

SEQ ID NO: 74301 - protein, 143 aa, Homo sapiens [sequence omitted]

SEQ ID NO: 74302 - protein, 55 aa, Homo sapiens
  Payload ID: 14690
  Gene Symbol: RPS23
  Gene Name: ribosomal protein S23
  ENSP ID: ENSP00000420900
MGKCRGLRTARKLRSHRRDQKWHDKQYKKAHLGTALKANPFGGASHAKGIVLEKV

SEQ ID NO: 74303 - protein, 123 aa, Homo sapiens
  Payload ID: 14690
  Gene Symbol: RPS23
  Gene Name: ribosomal protein S23
  ENSP ID: ENSP00000422071
MGKCRGLRTARKLRSHRRDQKWHDKQYKKAHLGTALKANPFGGASHAKGIVLEKVGVEAKQPNSAIRKCVRVQLIKNGKKITAFVPNDGCLNFIEVSISTLSYLLFLGWPPSHFYLMQGSFLT

SEQ ID NO: 74304 - protein, 85 aa, Homo sapiens
  Payload ID: 14690
  Gene Symbol: RPS23
  Gene Name: ribosomal protein S23
  ENSP ID: ENSP00000425833
MGKCRGLRTARKLRSHRRDQKWHDKQYKKAHLGTALKANPFGGASHAKGIVLEKVGVEAKQPNSAIRKCVRVQLIKNGKKERPRS

SEQ ID NO: 74305 - protein, 134 aa, Homo sapiens
  Payload ID: 14690
  Gene Symbol: RPS23
  Gene Name: ribosomal protein S23
  ENSP ID: ENSP00000425865
MGKCRGLRTARKLRSHRRDQKWHDKQYKKAHLGTALKANPFGGASHAKGIVLEKVGVEAKQPNSAIRKCVRVQLIKNGKKITAFVPNDGCLNFIEENDEVLVAGFGRKGHAVGDIPGVRFKSFHGYSGMVEMKL

SEQ ID NO: 74306 - protein, 134 aa, Homo sapiens; identical to SEQ ID NO: 74305
  Payload ID: 14690
  Gene Symbol: RPS23
  Gene Name: ribosomal protein S23
  ENSP ID: ENSP00000427043

SEQ ID NO: 74307 - protein, 130 aa, Homo sapiens
  Payload ID: 14691
  Gene Symbol: RPS24
  Gene Name: ribosomal protein S24
  Uniprot ID: P62847
  ENSP ID: ENSP00000354074
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKK

SEQ ID NO: 74308 - protein, 133 aa, Homo sapiens [sequence omitted]

SEQ ID NO: 74309 - protein, 289 aa, Homo sapiens
  Payload ID: 14691
  Gene Symbol: RPS24
  Gene Name: ribosomal protein S24
  Uniprot ID: P62847
  ENSP ID: ENSP00000414321
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKKMRELGLGVQALGRISQEERCTDVKNSKARESRGVVWQVEVPGPWSVWTCGRLRRGCGKYLQVAVTWRKTENREQCCQACLLERALVRNGAFMSPASPAPAGSPHPVDGDLVLHLPEALSATLTLSPHIQAINKSFGPFFEIHQESSCFSPPSCLSGLGH

SEQ ID NO: 74310 - protein, 131 aa, Homo sapiens
  Payload ID: 14691
  Gene Symbol: RPS24
  Gene Name: ribosomal protein S24
  ENSP ID: ENSP00000415549
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKKQ

SEQ ID NO: 74311 - protein, 132 aa, Homo sapiens
  Payload ID: 14691
  Gene Symbol: RPS24
  Gene Name: ribosomal protein S24
  ENSP ID: ENSP00000478869
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKKKR

SEQ ID NO: 74312 - protein, 39 aa, Homo sapiens
  Payload ID: 14692
  Gene Symbol: RPS25
  Gene Name: ribosomal protein S25
  ENSP ID: ENSP00000431634
MPPKDDKKKKDAGKSAKKDKDPVNKSGGKAKKKVEIRPL

SEQ ID NO: 74313 - protein, 125 aa, Homo sapiens [sequence omitted]

SEQ ID NO: 74314 - protein, 39 aa, Homo sapiens
  Payload ID: 14692
  Gene Symbol: RPS25
  Gene Name: ribosomal protein S25
  ENSP ID: ENSP00000436193
MPPKDDKKKKDAGKSAKKDKDPVNKSGGKAKKKLWSLRD

SEQ ID NO: 74315 - protein, 39 aa, Homo sapiens; identical to SEQ ID NO: 74314
  Payload ID: 14692
  Gene Symbol: RPS25
  Gene Name: ribosomal protein S25
  ENSP ID: ENSP00000486011

SEQ ID NO: 74316 - protein, 125 aa, Homo sapiens [sequence omitted]

SEQ ID NO: 74317 - protein, 39 aa, Homo sapiens; identical to SEQ ID NO: 74312
  Payload ID: 14692
  Gene Symbol: RPS25
  Gene Name: ribosomal protein S25
  ENSP ID: ENSP00000486686

SEQ ID NO: 74318 - protein, 115 aa, Homo sapiens [sequence omitted]

SEQ ID NO: 74319 - protein, 115 aa, Homo sapiens [sequence omitted]

SEQ ID NO: 74320 - protein, 84 aa, Homo sapiens
  Payload ID: 14694
  Gene Symbol: RPS27
  Gene Name: ribosomal protein S27
  Uniprot ID: P42677
  ENSP ID: ENSP00000357555
MPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 74321 - protein, 66 aa, Homo sapiens
  Payload ID: 14694
  Gene Symbol: RPS27
  Gene Name: ribosomal protein S27
  ENSP ID: ENSP00000376341
MPLAKDLLHPSPEEEKRKHKKKRLVQSPNSYFMDVKCPGEETACCSGESTGPQQLENVVVLAVSYP

SEQ ID NO: 74322 - protein, 156 aa, Homo sapiens
  Payload ID: 14695
  Gene Symbol: RPS27A
  Gene Name: ribosomal protein S27a
  Uniprot ID: P62979
  ENSP ID: ENSP00000272317
MQIFVKTLTGKTITLEVEPSDTIENVKAKIQDKEGIPPDQQRLIFAGKQLEDGRTLSDYNIQKESTLHLVLRLRGGAKKRKKKSYTTPKKNKHKRKKVKLAVLKYYKVDENGKISRLRRECPSDECGAGVFMASHFDRHYCGKCCLTYCFNKPEDK

SEQ ID NO: 74323 - protein, 156 aa, Homo sapiens; identical to SEQ ID NO: 74322
  Payload ID: 14695
  Gene Symbol: RPS27A
  Gene Name: ribosomal protein S27a
  Uniprot ID: P62979
  ENSP ID: ENSP00000383981

SEQ ID NO: 74324 - protein, 156 aa, Homo sapiens; identical to SEQ ID NO: 74322
  Payload ID: 14695
  Gene Symbol: RPS27A
  Gene Name: ribosomal protein S27a
  Uniprot ID: P62979
  ENSP ID: ENSP00000385659

SEQ ID NO: 74325 - protein, 106 aa, Homo sapiens
  Payload ID: 14695
  Gene Symbol: RPS27A
  Gene Name: ribosomal protein S27a
  ENSP ID: ENSP00000408482
MQIFVKTLTGKTITLEVEPSDTIENVKAKIQDKEGIPPDQQRLIFAGKQLEDGRTLSDYNIQKESTLHLVLRLRGGAKKRKKKSYTTPKKNKHKRKKVKLAVLKYY

SEQ ID NO: 74326 - protein, 84 aa, Homo sapiens
  Payload ID: 14696
  Gene Symbol: RPS27L
  Gene Name: ribosomal protein S27-like
  Uniprot ID: Q71UM5
  ENSP ID: ENSP00000331019
MPLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 74327 - protein, 97 aa, Homo sapiens
  Payload ID: 14696
  Gene Symbol: RPS27L
  Gene Name: ribosomal protein S27-like
  ENSP ID: ENSP00000402423
MPLARDLLHPSLEEEKKKHKKKRLVQSPNSYFMDVKCPGCYKITTVFSHAQTVVLCVGCSTVLCQPTGGKARLTEGISFGILQPSDEIDDYKCLYLH

SEQ ID NO: 74328 - protein, 52 aa, Homo sapiens
  Payload ID: 14696
  Gene Symbol: RPS27L
  Gene Name: ribosomal protein S27-like
  ENSP ID: ENSP00000405300
MDVKCPGCYKITTVFSHAQTVVLCVGCSTVLCQPTGGKARLTEGCSFRRKQH

SEQ ID NO: 74329 - protein, 52 aa, Homo sapiens; identical to SEQ ID NO: 74328
  Payload ID: 14696
  Gene Symbol: RPS27L
  Gene Name: ribosomal protein S27-like
  ENSP ID: ENSP00000412026

SEQ ID NO: 74330 - protein, 100 aa, Homo sapiens
  Payload ID: 14696
  Gene Symbol: RPS27L
  Gene Name: ribosomal protein S27-like
  ENSP ID: ENSP00000453764
MCQRCGLKLIVIICFFVQLARDLLHPSLEEEKKKHKKKRLVQSPNSYFMDVKCPGCYKITTVFSHAQTVVLCVGCSTVLCQPTGGKARLTEGCSFRRKQH

SEQ ID NO: 74331 - protein, 52 aa, Homo sapiens; identical to SEQ ID NO: 74328
  Payload ID: 14696
  Gene Symbol: RPS27L
  Gene Name: ribosomal protein S27-like
  ENSP ID: ENSP00000489261

SEQ ID NO: 74332 - protein, 69 aa, Homo sapiens [sequence omitted]

SEQ ID NO: 74333 - protein, 56 aa, Homo sapiens [sequence omitted]

SEQ ID NO: 74334 - protein, 67 aa, Homo sapiens
  Payload ID: 14698
  Gene Symbol: RPS29
  Gene Name: ribosomal protein S29
  Uniprot ID: P62273
  ENSP ID: ENSP00000379339
MGHQQLYWSHPRKFGQGSRSCRVCSNRHGLIRKYGLNMCRQCFRQYAKDIGFIKKDLSCLPWHCLWR

SEQ ID NO: 74335 - protein, 53 aa, Homo sapiens
  Payload ID: 14698
  Gene Symbol: RPS29
  Gene Name: ribosomal protein S29
  ENSP ID: ENSP00000478117
MAVFDLAIPAEQIIFHGGRVCSNRHGLIRKYGLNMCRQCFRQYAKDIGFIKLD

SEQ ID NO: 74336 - protein, 56 aa, Homo sapiens [sequence omitted]

SEQ ID NO: 74337 - protein, 259 aa, Homo sapiens
  Payload ID: 14699
  Gene Symbol: RPS3
  Gene Name: ribosomal protein S3
  Uniprot ID: P23396
  ENSP ID: ENSP00000278572
MAVQISKKRKFVADGIFKAELNEFLTRELAEDGYSGVEVRVTPTRTEIIILATRTQNVLGEKGRRIRELTAVVQKRFGFPEGSVELKIMVMVTGYPLLPLKLYAEKVATRGLCAIAQAESLRYKLLGGLAVRRACYGVLRFIMESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGGKPEPPAMPQPVPTA

SEQ ID NO: 74338 - protein, 103 aa, Homo sapiens
  Payload ID: 14699
  Gene Symbol: RPS3
  Gene Name: ribosomal protein S3
  ENSP ID: ENSP00000416745
MESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGG

SEQ ID NO: 74339 - protein, 135 aa, Homo sapiens
  Payload ID: 14699
  Gene Symbol: RPS3
  Gene Name: ribosomal protein S3
  ENSP ID: ENSP00000431737
QISKKRKFVADGIFKAELNEFLTRELAEDGYSGVEVRVTPTRTEIIILATRTQNVLGEKGRRIRELTAVVQKRFGFPEGSVELYAEKVATRGLCAIAQAESLRYKLLGGLAVRRVGPKAARLWCLGNSEDRGLNP

SEQ ID NO: 74340 - protein, 115 aa, Homo sapiens
  Payload ID: 14699
  Gene Symbol: RPS3
  Gene Name: ribosomal protein S3
  ENSP ID: ENSP00000431834
MAVQISKKRKFVADGIFKAELNEFLTRELAEDGYSGVEVRVTPTRTEIIILATRTQNVLGEKGRRIRELTAVVQKRFGFPEGSVEGLLWCAAVHHGEWGQRLRGCGVWETPRTEG

SEQ ID NO: 74341 - protein, 44 aa, Homo sapiens
  Payload ID: 14699
  Gene Symbol: RPS3
  Gene Name: ribosomal protein S3
  ENSP ID: ENSP00000432458
MAVQISKKRKFVADGIFKAELNEFLTRELAEDGYSGVENTECSW

SEQ ID NO: 74342 - protein, 91 aa, Homo sapiens
  Payload ID: 14699
  Gene Symbol: RPS3
  Gene Name: ribosomal protein S3
  ENSP ID: ENSP00000432542
MAVQISKKRKFVADGIFKAELNEFLTRELAEDGYSGVEVRVTPTRTEIIILATRTQNVLGEKGRRIRELTAVVQKRFGFPEGSVEHCGTQR

SEQ ID NO: 74343 - protein, 117 aa, Homo sapiens
  Payload ID: 14699
  Gene Symbol: RPS3
  Gene Name: ribosomal protein S3
  ENSP ID: ENSP00000433155
MAVQISKKRKFVADGIFKAELNEFLTRELAEDGYSGVEVRVTPTRTEIIILATRTQNVLGEKGRRIRELTAVVQKRFGFPEGSVELYAEKVATRGLCAIAQAESLRYKLLGGLAVRR

SEQ ID NO: 74344 - protein, 231 aa, Homo sapiens
  Payload ID: 14699
  Gene Symbol: RPS3
  Gene Name: ribosomal protein S3
  ENSP ID: ENSP00000433421
MAVQISKKRKFVADGIFKAELNEFLTRELAEDGYSGVEVRVTPTRTEIIILATRTQNVLGEKGRRIRELTAVVQKRFGFPEGSLCAIAQAESLRYKLLGGLAVRRACYGVLRFIMESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGGKPEPPAMPQPVPTA

SEQ ID NO: 74345 - protein, 243 aa, Homo sapiens
  Payload ID: 14699
  Gene Symbol: RPS3
  Gene Name: ribosomal protein S3
  Uniprot ID: P23396
  ENSP ID: ENSP00000433821
MAVQISKKRKFVADGIFKAELNEFLTRELAEDGYSGVEVRVTPTRTEIIILATRTQNVLGEKGRRIRELTAVVQKRFGFPEGSVELYAEKVATRGLCAIAQAESLRYKLLGGLAVRRACYGVLRFIMESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGGKPEPPAMPQPVPTA

SEQ ID NO: 74346 - protein, 243 aa, Homo sapiens; identical to SEQ ID NO: 74345
  Payload ID: 14699
  Gene Symbol: RPS3
  Gene Name: ribosomal protein S3
  Uniprot ID: P23396
  ENSP ID: ENSP00000434643

SEQ ID NO: 74347 - protein, 128 aa, Homo sapiens
  Payload ID: 14699
  Gene Symbol: RPS3
  Gene Name: ribosomal protein S3
  ENSP ID: ENSP00000435457
MAVQISKKRKFVADGIFKAELNEFLTRELAEDGYSGVEVRVTPTRTEIIILATRTQNVLGEKGRRIRELTAVVQKRSVCHCPGRVSALQTPRRACCAEGLLWCAAVHHGEWGQRLRGCGVWETPRTEG

SEQ ID NO: 74348 - protein, 36 aa, Homo sapiens
  Payload ID: 14699
  Gene Symbol: RPS3
  Gene Name: ribosomal protein S3
  ENSP ID: ENSP00000435566
MESGAKGCEVVVSGKLRGQRAKSMKFVDGLMIHSGD

SEQ ID NO: 74349 - protein, 158 aa, Homo sapiens
  Payload ID: 14699
  Gene Symbol: RPS3
  Gene Name: ribosomal protein S3
  ENSP ID: ENSP00000436335
MAVQISKKRKFVADGIFKAELNEFLTRELAEDGYSGVEVRVTPTRTEIIILATRTQNVLGEKGRRIRELTAVVQKRFGFPEGSVELYAEKVATRGVLGIKVKIMLPWDPTGKIGPKKPLPDHVSIVEPKDEILPTTPISEQKGGKPEPPAMPQPVPTA

SEQ ID NO: 74350 - protein, 33 aa, Homo sapiens
  Payload ID: 14699
  Gene Symbol: RPS3
  Gene Name: ribosomal protein S3
  ENSP ID: ENSP00000436476
  MOD_RES (1)..(1): Any amino acid
XFVADGIFKAELNEFLTRELAEDGYSGVERRPC

SEQ ID NO: 74351 - protein, 171 aa, Homo sapiens
  Payload ID: 14699
  Gene Symbol: RPS3
  Gene Name: ribosomal protein S3
  ENSP ID: ENSP00000436556
  MOD_RES (1)..(1): Any amino acid
XFVADGIFKAELNEFLTRELAEDGYSGVEVRVTPTRTEIIILATRACYGVLRFIMESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGGKPEPPAMPQPVPTA

SEQ ID NO: 74352 - protein, 243 aa, Homo sapiens; identical to SEQ ID NO: 74345
  Payload ID: 14699
  Gene Symbol: RPS3
  Gene Name: ribosomal protein S3
  Uniprot ID: P23396
  ENSP ID: ENSP00000436971

SEQ ID NO: 74353 - protein, 123 aa, Homo sapiens
  Payload ID: 14699
  Gene Symbol: RPS3
  Gene Name: ribosomal protein S3
  ENSP ID: ENSP00000437105
  MOD_RES (1)..(1): Any amino acid
XVADGIFKAELNEFLTRELAEDGYSGVEVRVTPTRTEIIILATRTQNVLGEKGRRIRELTAVVQKRFGFPEGSVELYAEKVATRGLCAIAQAESLRYKLLGGLAVRRCAGHQGEDHAALGPNW

SEQ ID NO: 74354 - protein, 264 aa, Homo sapiens [sequence omitted]

SEQ ID NO: 74355 - protein, 65 aa, Homo sapiens
  Payload ID: 14700
  Gene Symbol: RPS3A
  Gene Name: ribosomal protein S3A
  ENSP ID: ENSP00000421277
MFNIRNIGKTLVTRTQGTKIASDGLKGRVFEVSLADLQNDEVAFRKFKLITEDVQGKNCLTNFHG

SEQ ID NO: 74356 - protein, 190 aa, Homo sapiens
  Payload ID: 14700
  Gene Symbol: RPS3A
  Gene Name: ribosomal protein S3A
  ENSP ID: ENSP00000421457
NKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREDSRQHWKRHRKGLPIYLSSP

SEQ ID NO: 74357 - protein, 227 aa, Homo sapiens
  Payload ID: 14700
  Gene Symbol: RPS3A
  Gene Name: ribosomal protein S3A
  ENSP ID: ENSP00000421770
MFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 74358 - protein, 125 aa, Homo sapiens
  Payload ID: 14700
  Gene Symbol: RPS3A
  Gene Name: ribosomal protein S3A
  ENSP ID: ENSP00000421776
MFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVR

SEQ ID NO: 74359 - protein, 145 aa, Homo sapiens
  Payload ID: 14700
  Gene Symbol: RPS3A
  Gene Name: ribosomal protein S3A
  ENSP ID: ENSP00000422994
MIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 74360 - protein, 205 aa, Homo sapiens
  Payload ID: 14700
  Gene Symbol: RPS3A
  Gene Name: ribosomal protein S3A
  ENSP ID: ENSP00000423953
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLQHWKRHRKGLPIYLSSP

SEQ ID NO: 74361 - protein, 193 aa, Homo sapiens
  Payload ID: 14700
  Gene Symbol: RPS3A
  Gene Name: ribosomal protein S3A
  ENSP ID: ENSP00000424547
MFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLME

SEQ ID NO: 74362 - protein, 101 aa, Homo sapiens
  Payload ID: 14700
  Gene Symbol: RPS3A
  Gene Name: ribosomal protein S3A
  ENSP ID: ENSP00000425024
MFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLF

SEQ ID NO: 74363 - protein, 208 aa, Homo sapiens
  Payload ID: 14700
  Gene Symbol: RPS3A
  Gene Name: ribosomal protein S3A
  ENSP ID: ENSP00000425508
KRLTKGGKKGAKKKVVDPFSKKDWYDVKAPAMFNIRNIGKTLVTRTQGTKIASDGLKGRVFETMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 74364 - protein, 95 aa, Homo sapiens
  Payload ID: 14700
  Gene Symbol: RPS3A
  Gene Name: ribosomal protein S3A
  ENSP ID: ENSP00000425978
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQDND

SEQ ID NO: 74365 - protein, 227 aa, Homo sapiens; identical to SEQ ID NO: 74357
  Payload ID: 14700
  Gene Symbol: RPS3A
  Gene Name: ribosomal protein S3A
  ENSP ID: ENSP00000426282

SEQ ID NO: 74366 - protein, 223 aa, Homo sapiens
  Payload ID: 14700
  Gene Symbol: RPS3A
  Gene Name: ribosomal protein S3A
  ENSP ID: ENSP00000426466
MVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATG

SEQ ID NO: 74367 - protein, 263 aa, Homo sapiens [sequence omitted]

SEQ ID NO: 74368 - protein, 263 aa, Homo sapiens
  Payload ID: 14702
  Gene Symbol: RPS4Y1
  Gene Name: ribosomal protein S4, Y-linked 1
  Uniprot ID: P22090
  ENSP ID: ENSP00000250784
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 74369 - protein, 262 aa, Homo sapiens
  Payload ID: 14702
  Gene Symbol: RPS4Y1
  Gene Name: ribosomal protein S4, Y-linked 1
  ENSP ID: ENSP00000415317
MLGRPAKFSKARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERD

SEQ ID NO: 74370 - protein, 263 aa, Homo sapiens
  Payload ID: 14703
  Gene Symbol: RPS4Y2
  Gene Name: ribosomal protein S4, Y-linked 2
  Uniprot ID: Q8TD47
  ENSP ID: ENSP00000486252
MARGPKKHLKRVAAPKHWMLDKLTGVFAPRPSTGPHKLRECLPLIVFLRNRLKYALTGDEVKKICMQHFLKIDGKVRVDITYPAGFIDVISIEKTGEHFRLVYNTKGCFAVHRITVEEAKYKLCKVRKITVGTKGIPHLVTHDARTIRYPDPLIKVNDTVQIDLGTGKITSFIKFDTGNVCMVIAGANLGRVGVITNRERHPGSCDVVHVKDANGNSFATRISNIFVIGNGNKPWISLPRGKGIRLTIAEERDKRLAAKQSSG

SEQ ID NO: 74371 - protein, 204 aa, Homo sapiens [sequence omitted]

SEQ ID NO: 74372 - protein, 204 aa, Homo sapiens [sequence omitted]

SEQ ID NO: 74373 - protein, 134 aa, Homo sapiens
  Payload ID: 14704
  Gene Symbol: RPS5
  Gene Name: ribosomal protein S5
  ENSP ID: ENSP00000470660
MTEWETAAPAVAETPDIKLFGKWSTDDVQINDISLQNPLQVLVNAIINSGPREDSTRIGRAGTVRRQAVDVSPLRRVNQAIWLLCTGAREAAFRNIKTIAECLADELINAAKGSSNSYAIKKKDELERVAKSNR

SEQ ID NO: 74374 - protein, 200 aa, Homo sapiens
  Payload ID: 14704
  Gene Symbol: RPS5
  Gene Name: ribosomal protein S5
  ENSP ID: ENSP00000471185
MTEWETAAPAVAETPDIKLFGKWSTDDVQINDISLQDYIAVKEKYAKYLPHSAGRYAAKRFRKAQCPIVERLTNSMMMHGRNNGKKLMTVRIVKHAFEIIHLLTGENPLQVLVNAIINSGPREDSTRIGRAGTVRRQAVDVSPLRRVNQAIWLLCTGAREAAFRNIKTIAECLADELINAAKGSSNSYAIKKKDELERVA

SEQ ID NO: 74375 - protein, 225 aa, Homo sapiens
  Payload ID: 14704
  Gene Symbol: RPS5
  Gene Name: ribosomal protein S5
  ENSP ID: ENSP00000471388
MTEWETAAPAVAETPDIKLFGKWSTDDVQINDISLQMTTTSVMRGLLHQKEHHISHMDYIAVKEKYAKYLPHSAGRYAAKRFRKAQCPIVERLTNSMMMHGRNNGKKLMTVRIVKHAFEIIHLLTGENPLQVLVNAIINSGPREDSTRIGRAGTVRRQAVDVSPLRRVNQAIWLLCTGAREAAFRNIKTIAECLADELINAAKGSSNSYAIKKKDELERVAKSNR

SEQ ID NO: 74376 - protein, 204 aa, Homo sapiens [sequence omitted]

SEQ ID NO: 74377 - protein, 91 aa, Homo sapiens
  Payload ID: 14705
  Gene Symbol: RPS6
  Gene Name: ribosomal protein S6
  ENSP ID: ENSP00000369741
MKLNISFPATGCQKLIEVDDERKLRTFYEKRMATEVAADALGEEWKVKVDKLLQVFKSETVNAIGNWYLEWGSDSGFWLLTFGKLLPNATL

SEQ ID NO: 74378 - protein, 218 aa, Homo sapiens
  Payload ID: 14705
  Gene Symbol: RPS6
  Gene Name: ribosomal protein S6
  ENSP ID: ENSP00000369743
MATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 74379 - protein, 218 aa, Homo sapiens; identical to SEQ ID NO: 74378
  Payload ID: 14705
  Gene Symbol: RPS6
  Gene Name: ribosomal protein S6
  ENSP ID: ENSP00000369745

SEQ ID NO: 74380 - protein, 249 aa, Homo sapiens
  Payload ID: 14705
  Gene Symbol: RPS6
  Gene Name: ribosomal protein S6
  Uniprot ID: P62753
  ENSP ID: ENSP00000369757
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 74381 - protein, 1054 aa, Homo sapiens
  Payload ID: 14706
  Gene Symbol: RPS6KC1
  Gene Name: ribosomal protein S6 kinase, 52kDa, polypeptide 1
  Uniprot ID: Q96S38
  ENSP ID: ENSP00000355926
MTSYRERSADLARFYTVTEPQRHPRGYTVYKVTARIIVWKRYSDFKKLHKELWQIHKNLFRHSELFPPFAKGIVFGRFDETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 74382 - protein, 1066 aa, Homo sapiens
  Payload ID: 14706
  Gene Symbol: RPS6KC1
  Gene Name: ribosomal protein S6 kinase, 52kDa, polypeptide 1
  Uniprot ID: Q96S38
  ENSP ID: ENSP00000355927
MTSYRERSADLARFYTVTEPQRHPRGYTVYKVTARVVSRRNPEDVQEIIVWKRYSDFKKLHKELWQIHKNLFRHSELFPPFAKGIVFGRFDETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 74383 - protein, 885 aa, Homo sapiens
  Payload ID: 14706
  Gene Symbol: RPS6KC1
  Gene Name: ribosomal protein S6 kinase, 52kDa, polypeptide 1
  ENSP ID: ENSP00000439282
MASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 74384 - protein, 854 aa, Homo sapiens
  Payload ID: 14706
  Gene Symbol: RPS6KC1
  Gene Name: ribosomal protein S6 kinase, 52kDa, polypeptide 1
  ENSP ID: ENSP00000442306
MASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 74385 - protein, 854 aa, Homo sapiens; identical to SEQ ID NO: 74384
  Payload ID: 14706
  Gene Symbol: RPS6KC1
  Gene Name: ribosomal protein S6 kinase, 52kDa, polypeptide 1
  ENSP ID: ENSP00000483873

SEQ ID NO: 74386 - protein, 601 aa, Homo sapiens
  Payload ID: 14706
  Gene Symbol: RPS6KC1
  Gene Name: ribosomal protein S6 kinase, 52kDa, polypeptide 1
  ENSP ID: ENSP00000484471
MLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 74387 - protein, 525 aa, Homo sapiens
  Payload ID: 14707
  Gene Symbol: RPS6KB1
  Gene Name: ribosomal protein S6 kinase, 70kDa, polypeptide 1
  Uniprot ID: P23443
  ENSP ID: ENSP00000225577
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 74388 - protein, 472 aa, Homo sapiens
  Payload ID: 14707
  Gene Symbol: RPS6KB1
  Gene Name: ribosomal protein S6 kinase, 70kDa, polypeptide 1
  Uniprot ID: P23443
  ENSP ID: ENSP00000376744
MDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 74389 - protein, 451 aa, Homo sapiens
  Payload ID: 14707
  Gene Symbol: RPS6KB1
  Gene Name: ribosomal protein S6 kinase, 70kDa, polypeptide 1
  Uniprot ID: P23443
  ENSP ID: ENSP00000384335
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSTAMC

SEQ ID NO: 74390 - protein, 502 aa, Homo sapiens
  Payload ID: 14707
  Gene Symbol: RPS6KB1
  Gene Name: ribosomal protein S6 kinase, 70kDa, polypeptide 1
  Uniprot ID: P23443
  ENSP ID: ENSP00000441993
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 74391 - protein, 62 aa, Homo sapiens
  Payload ID: 14707
  Gene Symbol: RPS6KB1
  Gene Name: ribosomal protein S6 kinase, 70kDa, polypeptide 1
  ENSP ID: ENSP00000464805
MDHGGVGPYELGMEHCEKFEISETSVNRGPEKIRPECFELLRVLGKGGYGKVFQVRKVTGAN

SEQ ID NO: 74392 - protein, 52 aa, Homo sapiens
  Payload ID: 14707
  Gene Symbol: RPS6KB1
  Gene Name: ribosomal protein S6 kinase, 70kDa, polypeptide 1
  ENSP ID: ENSP00000466562
MRRRRRRDGFYPAPDFRDREAEDMAGVFDIDLDQPEDAGSEDELEEGEALSC

SEQ ID NO: 74393 - protein, 140 aa, Homo sapiens
  Payload ID: 14707
  Gene Symbol: RPS6KB1
  Gene Name: ribosomal protein S6 kinase, 70kDa, polypeptide 1
  ENSP ID: ENSP00000468058
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKMISFPLGNDSKKC

SEQ ID NO: 74394 - protein, 482 aa, Homo sapiens
  Payload ID: 14708
  Gene Symbol: RPS6KB2
  Gene Name: ribosomal protein S6 kinase, 70kDa, polypeptide 2
  Uniprot ID: Q9UBS0
  ENSP ID: ENSP00000308413
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSGGELFTHLEREGIFLEDTACFYLAEITLALGHLHSQGIIYRDLKPENIMLSSQGHIKLTDFGLCKESIHEGAVTHTFCGTIEYMAPEILVRSGHNRAVDWWSLGALMYDMLTGSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRAPVSPLKFSPFEGFRPSPSLPEPTELPLPPLLPPPPPSTTAPLPIRPPSGTKKSKRGRGRPGR

SEQ ID NO: 74395 - protein, 20 aa, Homo sapiens
  Payload ID: 14708
  Gene Symbol: RPS6KB2
  Gene Name: ribosomal protein S6 kinase, 70kDa, polypeptide 2
  ENSP ID: ENSP00000410175
MLSSQGHIKLTDFGLCKESI

SEQ ID NO: 74396 - protein, 154 aa, Homo sapiens
  Payload ID: 14708
  Gene Symbol: RPS6KB2
  Gene Name: ribosomal protein S6 kinase, 70kDa, polypeptide 2
  Uniprot ID: Q9UBS0
  ENSP ID: ENSP00000432847
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSVD

SEQ ID NO: 74397 - protein, 138 aa, Homo sapiens
  Payload ID: 14708
  Gene Symbol: RPS6KB2
  Gene Name: ribosomal protein S6 kinase, 70kDa, polypeptide 2
  ENSP ID: ENSP00000436811
MAAVFDLDLETEEGSEGEGEPELSPASNLNGSGEVSWHLPWLLPLGFSQDACPLAELRAAGLEPVGHYEEVELTETSVNVGPERIGPHCFELLRVLGKGGYGKVFQVRKVQGTNLGKIYAMKVLRKAKIVRNAKDTAH

SEQ ID NO: 74398 - protein, 153 aa, Homo sapiens
  Payload ID: 14708
  Gene Symbol: RPS6KB2
  Gene Name: ribosomal protein S6 kinase, 70kDa, polypeptide 2
  ENSP ID: ENSP00000450621
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSD

SEQ ID NO: 74399 - protein, 107 aa, Homo sapiens
  Payload ID: 14708
  Gene Symbol: RPS6KB2
  Gene Name: ribosomal protein S6 kinase, 70kDa, polypeptide 2
  ENSP ID: ENSP00000473485
VFQVRKVQGTNLGKIYAMKVLRKAKIVRNAKDTAHTRAERNILESVKHPFIVELAYAFQTGGKLYLILECLSGGELFTHLEREGIFLEDTAWPHQTDRLWTLQGVYP

SEQ ID NO: 74400 - protein, 111 aa, Homo sapiens
  Payload ID: 14709
  Gene Symbol: RPS6KA1
  Gene Name: ribosomal protein S6 kinase, 90kDa, polypeptide 1
  ENSP ID: ENSP00000355831
MQTPADFPRVERDLVPCPRKVQQQEPTALPLTPSWGSLPCCLPVCLPGVRPICPRMRASSRRSPSRTTSRLALRRLIHPISSSSRFWARDPLAKSSWCGKSPGLTVGTCML

SEQ ID NO: 74401 - protein, 204 aa, Homo sapiens
  Payload ID: 14709
  Gene Symbol: RPS6KA1
  Gene Name: ribosomal protein S6 kinase, 90kDa, polypeptide 1
  ENSP ID: ENSP00000363278
MEQDPKPPRLRLWALIPWLPRKQRPRISQTSLPVPGPGSGPQRDSDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVIYMIQKKNIHEEVFLPPQPPLFPSIGDVHGGGCEVLPG

SEQ ID NO: 74402 - protein, 724 aa, Homo sapiens
  Payload ID: 14709
  Gene Symbol: RPS6KA1
  Gene Name: ribosomal protein S6 kinase, 90kDa, polypeptide 1
  ENSP ID: ENSP00000363281
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 74403 - protein, 735 aa, Homo sapiens
  Payload ID: 14709
  Gene Symbol: RPS6KA1
  Gene Name: ribosomal protein S6 kinase, 90kDa, polypeptide 1
  Uniprot ID: Q15418
  ENSP ID: ENSP00000363283
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 74404 - protein, 166 aa, Homo sapiens
  Payload ID: 14709
  Gene Symbol: RPS6KA1
  Gene Name: ribosomal protein S6 kinase, 90kDa, polypeptide 1
  ENSP ID: ENSP00000383967
AQPDDTFYFDTEFTSRTPKDSPGIPPSAGAHQLFRGFSFVATGLMEDDGKPRAPQAPLHSVVQVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNP

SEQ ID NO: 74405 - protein, 115 aa, Homo sapiens
  Payload ID: 14709
  Gene Symbol: RPS6KA1
  Gene Name: ribosomal protein S6 kinase, 90kDa, polypeptide 1
  ENSP ID: ENSP00000403548
NTVSETAKDLVSKMLHVDPHQRLTAKQVLQHPWVTQKDKLPQSQLSHQDLQLVKGAMAATYSALNSSKPTPQLKPIESSILAQRRVRKLPSTTLMDSSRLRLCWWKAIHCINFFL

SEQ ID NO: 74406 - protein, 643 aa, Homo sapiens
  Payload ID: 14709
  Gene Symbol: RPS6KA1
  Gene Name: ribosomal protein S6 kinase, 90kDa, polypeptide 1
  Uniprot ID: Q15418
  ENSP ID: ENSP00000431651
MKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 74407 - protein, 719 aa, Homo sapiens
  Payload ID: 14709
  Gene Symbol: RPS6KA1
  Gene Name: ribosomal protein S6 kinase, 90kDa, polypeptide 1
  Uniprot ID: Q15418
  ENSP ID: ENSP00000432281
MQTPADFPRVERDLVPCPRKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 74408 - protein, 112 aa, Homo sapiens
  Payload ID: 14709
  Gene Symbol: RPS6KA1
  Gene Name: ribosomal protein S6 kinase, 90kDa, polypeptide 1
  ENSP ID: ENSP00000433039
MKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLT

SEQ ID NO: 74409 - protein, 56 aa, Homo sapiens
  Payload ID: 14709
  Gene Symbol: RPS6KA1
  Gene Name: ribosomal protein S6 kinase, 90kDa, polypeptide 1
  ENSP ID: ENSP00000434616
MPLAQLKEPWPLMELVPLDPEKQLLTSLEGSVAPVPKRAEGHLFLCLLTPGSRSSP

SEQ ID NO: 74410 - protein, 744 aa, Homo sapiens
  Payload ID: 14709
  Gene Symbol: RPS6KA1
  Gene Name: ribosomal protein S6 kinase, 90kDa, polypeptide 1
  Uniprot ID: Q15418
  ENSP ID: ENSP00000435412
MEQDPKPPRLRLWALIPWLPRKQRPRISQTSLPVPGPGSGPQRDSDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 74411 - protein, 52 aa, Homo sapiens
  Payload ID: 14709
  Gene Symbol: RPS6KA1
  Gene Name: ribosomal protein S6 kinase, 90kDa, polypeptide 1
  ENSP ID: ENSP00000436990
MPLAQLKEPWPLMELVPLDPENGQTSGEEAGLQPSKYVTASGPRWRETSWLM

SEQ ID NO: 74412 - protein, 56 aa, Homo sapiens; identical to SEQ ID NO: 74409
  Payload ID: 14709
  Gene Symbol: RPS6KA1
  Gene Name: ribosomal protein S6 kinase, 90kDa, polypeptide 1
  ENSP ID: ENSP00000485797

SEQ ID NO: 74413 - protein, 724 aa, Homo sapiens; identical to SEQ ID NO: 74402
  Payload ID: 14709
  Gene Symbol: RPS6KA1
  Gene Name: ribosomal protein S6 kinase, 90kDa, polypeptide 1
  ENSP ID: ENSP00000486031

SEQ ID NO: 74414 - protein, 52 aa, Homo sapiens; identical to SEQ ID NO: 74411
  Payload ID: 14709
  Gene Symbol: RPS6KA1
  Gene Name: ribosomal protein S6 kinase, 90kDa, polypeptide 1
  ENSP ID: ENSP00000486119

SEQ ID NO: 74415 - protein, 166 aa, Homo sapiens; identical to SEQ ID NO: 74404
  Payload ID: 14709
  Gene Symbol: RPS6KA1
  Gene Name: ribosomal protein S6 kinase, 90kDa, polypeptide 1
  ENSP ID: ENSP00000486179

SEQ ID NO: 74416 - protein, 204 aa, Homo sapiens; identical to SEQ ID NO: 74401
  Payload ID: 14709
  Gene Symbol: RPS6KA1
  Gene Name: ribosomal protein S6 kinase, 90kDa, polypeptide 1
  ENSP ID: ENSP00000486849

SEQ ID NO: 74417 - protein, 735 aa, Homo sapiens; identical to SEQ ID NO: 74403
  Payload ID: 14709
  Gene Symbol: RPS6KA1
  Gene Name: ribosomal protein S6 kinase, 90kDa, polypeptide 1
  Uniprot ID: Q15418
  ENSP ID: ENSP00000486881

SEQ ID NO: 74418 - protein, 111 aa, Homo sapiens; identical to SEQ ID NO: 74400
  Payload ID: 14709
  Gene Symbol: RPS6KA1
  Gene Name: ribosomal protein S6 kinase, 90kDa, polypeptide 1
  ENSP ID: ENSP00000487154

SEQ ID NO: 74419 - protein, 643 aa, Homo sapiens; identical to SEQ ID NO: 74406
  Payload ID: 14709
  Gene Symbol: RPS6KA1
  Gene Name: ribosomal protein S6 kinase, 90kDa, polypeptide 1
  Uniprot ID: Q15418
  ENSP ID: ENSP00000487166

SEQ ID NO: 74420 - protein, 115 aa, Homo sapiens; identical to SEQ ID NO: 74405
  Payload ID: 14709
  Gene Symbol: RPS6KA1
  Gene Name: ribosomal protein S6 kinase, 90kDa, polypeptide 1
  ENSP ID: ENSP00000487207

SEQ ID NO: 74421 - protein, 112 aa, Homo sapiens; identical to SEQ ID NO: 74408
  Payload ID: 14709
  Gene Symbol: RPS6KA1
  Gene Name: ribosomal protein S6 kinase, 90kDa, polypeptide 1
  ENSP ID: ENSP00000487239

SEQ ID NO: 74422 - protein, 744 aa, Homo sapiens; identical to SEQ ID NO: 74410
  Payload ID: 14709
  Gene Symbol: RPS6KA1
  Gene Name: ribosomal protein S6 kinase, 90kDa, polypeptide 1
  Uniprot ID: Q15418
  ENSP ID: ENSP00000487349

SEQ ID NO: 74423 - protein, 719 aa, Homo sapiens; identical to SEQ ID NO: 74407
  Payload ID: 14709
  Gene Symbol: RPS6KA1
  Gene Name: ribosomal protein S6 kinase, 90kDa, polypeptide 1
  Uniprot ID: Q15418
  ENSP ID: ENSP00000487553

SEQ ID NO: 74424 - protein, 733 aa, Homo sapiens
  Payload ID: 14710
  Gene Symbol: RPS6KA2
  Gene Name: ribosomal protein S6 kinase, 90kDa, polypeptide 2
  Uniprot ID: Q15349
  ENSP ID: ENSP00000265678
MDLSMKKFAVRRFFSVYLRRKSRSKSSSLSRLEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 74425 - protein, 644 aa, Homo sapiens
  Payload ID: 14710
  Gene Symbol: RPS6KA2
  Gene Name: ribosomal protein S6 kinase, 90kDa, polypeptide 2
  ENSP ID: ENSP00000386050
MKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 74426 - protein, 125 aa, Homo sapiens
  Payload ID: 14710
  Gene Symbol: RPS6KA2
  Gene Name: ribosomal protein S6 kinase, 90kDa, polypeptide 2
  ENSP ID: ENSP00000422197
MKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDK

SEQ ID NO: 74427 - protein, 758 aa, Homo sapiens
  Payload ID: 14710
  Gene Symbol: RPS6KA2
  Gene Name: ribosomal protein S6 kinase, 90kDa, polypeptide 2
  ENSP ID: ENSP00000422435
MPIAQLLELWKKIEVEPMEIETTEEDLNLDVEPTTEDTAEEGKSDSAACKTKVAGSVEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 74428 - protein, 644 aa, Homo sapiens; identical to SEQ ID NO: 74425
  Payload ID: 14710
  Gene Symbol: RPS6KA2
  Gene Name: ribosomal protein S6 kinase, 90kDa, polypeptide 2
  ENSP ID: ENSP00000422484

SEQ ID NO: 74429 - protein, 141 aa, Homo sapiens
  Payload ID: 14710
  Gene Symbol: RPS6KA2
  Gene Name: ribosomal protein S6 kinase, 90kDa, polypeptide 2
  ENSP ID: ENSP00000423114
MMIRLPHKKLQRLFLRKEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFT

SEQ ID NO: 74430 - protein, 171 aa, Homo sapiens
  Payload ID: 14710
  Gene Symbol: RPS6KA2
  Gene Name: ribosomal protein S6 kinase, 90kDa, polypeptide 2
  ENSP ID: ENSP00000425148
MPIAQLLELWKKIEVEPMEIETTEEDLNLDVEPTTEDTAEEGKSDSAACKTKVAGSVEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDL

SEQ ID NO: 74431 - protein, 36 aa, Homo sapiens
  Payload ID: 14710
  Gene Symbol: RPS6KA2
  Gene Name: ribosomal protein S6 kinase, 90kDa, polypeptide 2
  ENSP ID: ENSP00000425458
MKVLKKATLKVRDRVRSKMERDILAEVNHPFIVKLH

SEQ ID NO: 74432 - protein, 741 aa, Homo sapiens
  Payload ID: 14710
  Gene Symbol: RPS6KA2
  Gene Name: ribosomal protein S6 kinase, 90kDa, polypeptide 2
  Uniprot ID: Q15349
  ENSP ID: ENSP00000427015
MPIAQLLELWKKIEVEPMEIETTEEDLNLDVEPTTEDTAEEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 74433 - protein, 96 aa, Homo sapiens
  Payload ID: 14710
  Gene Symbol: RPS6KA2
  Gene Name: ribosomal protein S6 kinase, 90kDa, polypeptide 2
  ENSP ID: ENSP00000427605
MKVLKKATLKVRDRVRSKMERDILAEVNHPFIVKLHYAFQTEGKLYLILDFLRGGDLFTRLSKEVMFTEEDVKFYLAELALALDHLHSLGIIYRDL

SEQ ID NO: 74434 - protein, 740 aa, Homo sapiens
  Payload ID: 14711
  Gene Symbol: RPS6KA3
  Gene Name: ribosomal protein S6 kinase, 90kDa, polypeptide 3
  Uniprot ID: P51812
  ENSP ID: ENSP00000368884
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 74435 - protein, 133 aa, Homo sapiens
  Payload ID: 14711
  Gene Symbol: RPS6KA3
  Gene Name: ribosomal protein S6 kinase, 90kDa, polypeptide 3
  ENSP ID: ENSP00000388512
MDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSK

SEQ ID NO: 74436 - protein, 227 aa, Homo sapiens
  Payload ID: 14711
  Gene Symbol: RPS6KA3
  Gene Name: ribosomal protein S6 kinase, 90kDa, polypeptide 3
  ENSP ID: ENSP00000407655
MFKFLSFRVRSIQEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGV

SEQ ID NO: 74437 - protein, 772 aa, Homo sapiens
  Payload ID: 14712
  Gene Symbol: RPS6KA4
  Gene Name: ribosomal protein S6 kinase, 90kDa, polypeptide 4
  Uniprot ID: O75676
  ENSP ID: ENSP00000333896
MGDEDDDESCAVELRITEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQDSPFFQQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 74438 - protein, 704 aa, Homo sapiens
  Payload ID: 14712
  Gene Symbol: RPS6KA4
  Gene Name: ribosomal protein S6 kinase, 90kDa, polypeptide 4
  ENSP ID: ENSP00000432945
TEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAP

SEQ ID NO: 74439 - protein, 48 aa, Homo sapiens
  Payload ID: 14712
  Gene Symbol: RPS6KA4
  Gene Name: ribosomal protein S6 kinase, 90kDa, polypeptide 4
  ENSP ID: ENSP00000435314
MGDEDDDESCAVELRITEANLTGHEEKPTARCSWCGRRAGTTRGSCTP

SEQ ID NO: 74440 - protein, 765 aa, Homo sapiens
  Payload ID: 14712
  Gene Symbol: RPS6KA4
  Gene Name: ribosomal protein S6 kinase, 90kDa, polypeptide 4
  ENSP ID: ENSP00000435580
MGDEDDDESCAVELRITEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 74441 - protein, 807 aa, Homo sapiens
  Payload ID: 14713
  Gene Symbol: RPS6KA5
  Gene Name: ribosomal protein S6 kinase, 90kDa, polypeptide 5
  ENSP ID: ENSP00000261991
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFEALRKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSLRHGRSYQ
